United States Patent 12,551,560 (COMPOSITIONS AND METHODS FOR USE IN IMMUNOTHERAPY) - sequence listing, part 3

SEQ ID NO: 40526 - RNA, 20 nt, Artificial Sequence
  CIITA targeting sequence
aaaaaagaaaaagaaaaaag

SEQ ID NO: 40527 - RNA, 20 nt, Artificial Sequence
  CIITA targeting sequence
accucaaaaaaagaaaaaga

SEQ ID NO: 40528 - RNA, 20 nt, Artificial Sequence
  CIITA targeting sequence
cgcucugucacccaggcugg

SEQ ID NO: 40529 - RNA, 20 nt, Artificial Sequence
  CIITA targeting sequence
cucugucacccaggcuggag

SEQ ID NO: 40530 - RNA, 20 nt, Artificial Sequence
  CIITA targeting sequence
gucacccaggcuggagugca

SEQ ID NO: 40531 - RNA, 20 nt, Artificial Sequence
  CIITA targeting sequence
cccaggcuggagugcagugg

SEQ ID NO: 40532 - RNA, 20 nt, Artificial Sequence
  CIITA targeting sequence
agccugggugacagagcgag

SEQ ID NO: 40533 - RNA, 20 nt, Artificial Sequence
  CIITA targeting sequence
cgacucacugcaaccuccuc

SEQ ID NO: 40534 - RNA, 20 nt, Artificial Sequence
  CIITA targeting sequence
acucacugcaaccuccuccu

SEQ ID NO: 40535 - RNA, 20 nt, Artificial Sequence
  CIITA targeting sequence
agauugugccacugcacucc

SEQ ID NO: 40536 - RNA, 20 nt, Artificial Sequence
  CIITA targeting sequence
cugcaaccuccuccucccaa

SEQ ID NO: 40537 - RNA, 20 nt, Artificial Sequence
  CIITA targeting sequence
uccucccaaguccaagugau

SEQ ID NO: 40538 - RNA, 20 nt, Artificial Sequence
  CIITA targeting sequence
ucccaaguccaagugauucu

SEQ ID NO: 40539 - RNA, 20 nt, Artificial Sequence
  CIITA targeting sequence
caaguccaagugauucucuu

SEQ ID NO: 40540 - RNA, 20 nt, Artificial Sequence
  CIITA targeting sequence
aagugauucucuugccucag

SEQ ID NO: 40541 - RNA, 20 nt, Artificial Sequence
  CIITA targeting sequence
cuuggacuugggaggaggag

SEQ ID NO: 40542 - RNA, 20 nt, Artificial Sequence
  CIITA targeting sequence
cuugccucagccucccgagu

SEQ ID NO: 40543 - RNA, 20 nt, Artificial Sequence
  CIITA targeting sequence
ugccucagccucccgaguag

SEQ ID NO: 40544 - RNA, 20 nt, Artificial Sequence
  CIITA targeting sequence
gccucccgaguagcugggac

SEQ ID NO: 40545 - RNA, 20 nt, Artificial Sequence
  CIITA targeting sequence
cgaguagcugggacuacagg

SEQ ID NO: 40546 - RNA, 20 nt, Artificial Sequence
  CIITA targeting sequence
ggaggcugaggcaagagaau

SEQ ID NO: 40547 - RNA, 20 nt, Artificial Sequence
  CIITA targeting sequence
cagcuacucgggaggcugag

SEQ ID NO: 40548 - RNA, 20 nt, Artificial Sequence
  CIITA targeting sequence
ccacaucuggcuaauuuuuu

SEQ ID NO: 40549 - RNA, 20 nt, Artificial Sequence
  CIITA targeting sequence
ggcuaauuuuuuguauuuuu

SEQ ID NO: 40550 - RNA, 20 nt, Artificial Sequence
  CIITA targeting sequence
acuaaaaauacaaaaaauua

SEQ ID NO: 40551 - RNA, 20 nt, Artificial Sequence
  CIITA targeting sequence
cuacuaaaaauacaaaaaau

SEQ ID NO: 40552 - RNA, 20 nt, Artificial Sequence
  CIITA targeting sequence
ccguguuagccaggaugguc

SEQ ID NO: 40553 - RNA, 20 nt, Artificial Sequence
  CIITA targeting sequence
uggcuaacacggugaaaccc

SEQ ID NO: 40554 - RNA, 20 nt, Artificial Sequence
  CIITA targeting sequence
caaucuucugaccucgugau

SEQ ID NO: 40555 - RNA, 20 nt, Artificial Sequence
  CIITA targeting sequence
aucuucugaccucgugaucc

SEQ ID NO: 40556 - RNA, 20 nt, Artificial Sequence
  CIITA targeting sequence
ucugaccucgugaucccccc

SEQ ID NO: 40557 - RNA, 20 nt, Artificial Sequence
  CIITA targeting sequence
gaccucgugauccccccacc

SEQ ID NO: 40558 - RNA, 20 nt, Artificial Sequence
  CIITA targeting sequence
gaagauugagaccauccugg

SEQ ID NO: 40559 - RNA, 20 nt, Artificial Sequence
  CIITA targeting sequence
ugauccccccaccucggccu

SEQ ID NO: 40560 - RNA, 20 nt, Artificial Sequence
  CIITA targeting sequence
cgaggucagaagauugagac

SEQ ID NO: 40561 - RNA, 20 nt, Artificial Sequence
  CIITA targeting sequence
ccccaccucggccucccaaa

SEQ ID NO: 40562 - RNA, 20 nt, Artificial Sequence
  CIITA targeting sequence
gccucccaaagugcugggau

SEQ ID NO: 40563 - RNA, 20 nt, Artificial Sequence
  CIITA targeting sequence
caaagugcugggauuacagg

SEQ ID NO: 40564 - RNA, 20 nt, Artificial Sequence
  CIITA targeting sequence
cagcacuuugggaggccgag

SEQ ID NO: 40565 - RNA, 20 nt, Artificial Sequence
  CIITA targeting sequence
cgccuguaaucccagcacuu

SEQ ID NO: 40566 - RNA, 20 nt, Artificial Sequence
  CIITA targeting sequence
gugaggucuuuucugacccu

SEQ ID NO: 40567 - RNA, 20 nt, Artificial Sequence
  CIITA targeting sequence
cugaggccgggugugguggc

SEQ ID NO: 40568 - RNA, 20 nt, Artificial Sequence
  CIITA targeting sequence
uuucugacccucacaguuaa

SEQ ID NO: 40569 - RNA, 20 nt, Artificial Sequence
  CIITA targeting sequence
gacccucacaguuaaaaaua

SEQ ID NO: 40570 - RNA, 20 nt, Artificial Sequence
  CIITA targeting sequence
gaaaagaccucacugaggcc

SEQ ID NO: 40571 - RNA, 20 nt, Artificial Sequence
  CIITA targeting sequence
caguuaaaaauaaaacucug

SEQ ID NO: 40572 - RNA, 20 nt, Artificial Sequence
  CIITA targeting sequence
ggccaggcgcaguggcuuau

SEQ ID NO: 40573 - RNA, 20 nt, Artificial Sequence
  CIITA targeting sequence
cagcacuuugggaggccgag

SEQ ID NO: 40574 - RNA, 20 nt, Artificial Sequence
  CIITA targeting sequence
caaagugcugggauuacagg

SEQ ID NO: 40575 - RNA, 20 nt, Artificial Sequence
  CIITA targeting sequence
gccucccaaagugcugggau

SEQ ID NO: 40576 - RNA, 20 nt, Artificial Sequence
  CIITA targeting sequence
accugccucggccucccaaa

SEQ ID NO: 40577 - RNA, 20 nt, Artificial Sequence
  CIITA targeting sequence
caaggccaggaguuugagac

SEQ ID NO: 40578 - RNA, 20 nt, Artificial Sequence
  CIITA targeting sequence
uggccuugugauccaccugc

SEQ ID NO: 40579 - RNA, 20 nt, Artificial Sequence
  CIITA targeting sequence
aacuccuggccuugugaucc

SEQ ID NO: 40580 - RNA, 20 nt, Artificial Sequence
  CIITA targeting sequence
caaacuccuggccuugugau

SEQ ID NO: 40581 - RNA, 20 nt, Artificial Sequence
  CIITA targeting sequence
cuauguuggccaggcugguc

SEQ ID NO: 40582 - RNA, 20 nt, Artificial Sequence
  CIITA targeting sequence
cuacuaaauauacaaaacaa

SEQ ID NO: 40583 - RNA, 20 nt, Artificial Sequence
  CIITA targeting sequence
acuaaauauacaaaacaaau

SEQ ID NO: 40584 - RNA, 20 nt, Artificial Sequence
  CIITA targeting sequence
cagcuacuugggaggcugag

SEQ ID NO: 40585 - RNA, 20 nt, Artificial Sequence
  CIITA targeting sequence
caaguagcugugacuacagg

SEQ ID NO: 40586 - RNA, 20 nt, Artificial Sequence
  CIITA targeting sequence
gccucccaaguagcugugac

SEQ ID NO: 40587 - RNA, 20 nt, Artificial Sequence
  CIITA targeting sequence
ugccucagccucccaaguag

SEQ ID NO: 40588 - RNA, 20 nt, Artificial Sequence
  CIITA targeting sequence
ccugccucagccucccaagu

SEQ ID NO: 40589 - RNA, 20 nt, Artificial Sequence
  CIITA targeting sequence
uuugaaaccgggaggcggag

SEQ ID NO: 40590 - RNA, 20 nt, Artificial Sequence
  CIITA targeting sequence
aaugauucuccugccucagc

SEQ ID NO: 40591 - RNA, 20 nt, Artificial Sequence
  CIITA targeting sequence
cgguuucaaaugauucuccu

SEQ ID NO: 40592 - RNA, 20 nt, Artificial Sequence
  CIITA targeting sequence
gccucccgguuucaaaugau

SEQ ID NO: 40593 - RNA, 20 nt, Artificial Sequence
  CIITA targeting sequence
ccgcaaccuccgccucccgg

SEQ ID NO: 40594 - RNA, 20 nt, Artificial Sequence
  CIITA targeting sequence
gcucaccgcaaccuccgccu

SEQ ID NO: 40595 - RNA, 20 nt, Artificial Sequence
  CIITA targeting sequence
cagcucaccgcaaccuccgc

SEQ ID NO: 40596 - RNA, 20 nt, Artificial Sequence
  CIITA targeting sequence
cgccacugcaguccagcuug

SEQ ID NO: 40597 - RNA, 20 nt, Artificial Sequence
  CIITA targeting sequence
agcuuggaugacagagugag

SEQ ID NO: 40598 - RNA, 20 nt, Artificial Sequence
  CIITA targeting sequence
aagcuggacugcaguggcgu

SEQ ID NO: 40599 - RNA, 20 nt, Artificial Sequence
  CIITA targeting sequence
uccaagcuggacugcagugg

SEQ ID NO: 40600 - RNA, 20 nt, Artificial Sequence
  CIITA targeting sequence
gucauccaagcuggacugca

SEQ ID NO: 40601 - RNA, 20 nt, Artificial Sequence
  CIITA targeting sequence
cucugucauccaagcuggac

SEQ ID NO: 40602 - RNA, 20 nt, Artificial Sequence
  CIITA targeting sequence
cacucugucauccaagcugg

SEQ ID NO: 40603 - RNA, 20 nt, Artificial Sequence
  CIITA targeting sequence
caaaaauaaauaaauaaaua

SEQ ID NO: 40604 - RNA, 20 nt, Artificial Sequence
  CIITA targeting sequence
aaaauaaauaaauaaauaaa

SEQ ID NO: 40605 - RNA, 20 nt, Artificial Sequence
  CIITA targeting sequence
auuuauuuauuuauuuauuu

SEQ ID NO: 40606 - RNA, 20 nt, Artificial Sequence
  CIITA targeting sequence
auuccccucaugguuaaaaa

SEQ ID NO: 40607 - RNA, 20 nt, Artificial Sequence
  CIITA targeting sequence
ccucaugguuaaaaaaaaaa

SEQ ID NO: 40608 - RNA, 20 nt, Artificial Sequence
  CIITA targeting sequence
ugguuaaaaaaaaaacucca

SEQ ID NO: 40609 - RNA, 20 nt, Artificial Sequence
  CIITA targeting sequence
aucccccucaccacuguaua

SEQ ID NO: 40610 - RNA, 20 nt, Artificial Sequence
  CIITA targeting sequence
cccucaccacuguauauuuc

SEQ ID NO: 40611 - RNA, 20 nt, Artificial Sequence
  CIITA targeting sequence
ccacuguauauuuccauaug

SEQ ID NO: 40612 - RNA, 20 nt, Artificial Sequence
  CIITA targeting sequence
auaugauucauugucucaga

SEQ ID NO: 40613 - RNA, 20 nt, Artificial Sequence
  CIITA targeting sequence
uauggaaauauacaguggug

SEQ ID NO: 40614 - RNA, 20 nt, Artificial Sequence
  CIITA targeting sequence
uugucucagacaucagcuug

SEQ ID NO: 40615 - RNA, 20 nt, Artificial Sequence
  CIITA targeting sequence
cagacaucagcuugcuuucc

SEQ ID NO: 40616 - RNA, 20 nt, Artificial Sequence
  CIITA targeting sequence
gacaucagcuugcuuuccga

SEQ ID NO: 40617 - RNA, 20 nt, Artificial Sequence
  CIITA targeting sequence
gagacaaugaaucauaugga

SEQ ID NO: 40618 - RNA, 20 nt, Artificial Sequence
  CIITA targeting sequence
gcuugcuuuccgauuucuuu

SEQ ID NO: 40619 - RNA, 20 nt, Artificial Sequence
  CIITA targeting sequence
gauuucuuugauuaucuguc

SEQ ID NO: 40620 - RNA, 20 nt, Artificial Sequence
  CIITA targeting sequence
gaaagcaagcugaugucuga

SEQ ID NO: 40621 - RNA, 20 nt, Artificial Sequence
  CIITA targeting sequence
uugauuaucugucuaucuuc

SEQ ID NO: 40622 - RNA, 20 nt, Artificial Sequence
  CIITA targeting sequence
aagaaaucggaaagcaagcu

SEQ ID NO: 40623 - RNA, 20 nt, Artificial Sequence
  CIITA targeting sequence
gucuaucuuccccccuggaa

SEQ ID NO: 40624 - RNA, 20 nt, Artificial Sequence
  CIITA targeting sequence
aucuuccccccuggaauguc

SEQ ID NO: 40625 - RNA, 20 nt, Artificial Sequence
  CIITA targeting sequence
uccccccuggaaugucagca

SEQ ID NO: 40626 - RNA, 20 nt, Artificial Sequence
  CIITA targeting sequence
ccccuggaaugucagcaccc

SEQ ID NO: 40627 - RNA, 20 nt, Artificial Sequence
  CIITA targeting sequence
aggggggaagauagacagau

SEQ ID NO: 40628 - RNA, 20 nt, Artificial Sequence
  CIITA targeting sequence
gcacccagaaggcagggauu

SEQ ID NO: 40629 - RNA, 20 nt, Artificial Sequence
  CIITA targeting sequence
gggugcugacauuccagggg

SEQ ID NO: 40630 - RNA, 20 nt, Artificial Sequence
  CIITA targeting sequence
cugccuucugggugcugaca

SEQ ID NO: 40631 - RNA, 20 nt, Artificial Sequence
  CIITA targeting sequence
ucuguuuggcccacaacuuu

SEQ ID NO: 40632 - RNA, 20 nt, Artificial Sequence
  CIITA targeting sequence
guuuggcccacaacuuuccu

SEQ ID NO: 40633 - RNA, 20 nt, Artificial Sequence
  CIITA targeting sequence
ucccugggccuggcacauag

SEQ ID NO: 40634 - RNA, 20 nt, Artificial Sequence
  CIITA targeting sequence
cugggccuggcacauaguag

SEQ ID NO: 40635 - RNA, 20 nt, Artificial Sequence
  CIITA targeting sequence
auauuuaacaacgaaugccu

SEQ ID NO: 40636 - RNA, 20 nt, Artificial Sequence
  CIITA targeting sequence
uuguuaaauauugaccgcuu

SEQ ID NO: 40637 - RNA, 20 nt, Artificial Sequence
  CIITA targeting sequence
aagaacccccauaagauugg

SEQ ID NO: 40638 - RNA, 20 nt, Artificial Sequence
  CIITA targeting sequence
uggauuaaggcauucguugu

SEQ ID NO: 40639 - RNA, 20 nt, Artificial Sequence
  CIITA targeting sequence
uauggggguucuuggauuaa

SEQ ID NO: 40640 - RNA, 20 nt, Artificial Sequence
  CIITA targeting sequence
ccccaaucuuauggggguuc

SEQ ID NO: 40641 - RNA, 20 nt, Artificial Sequence
  CIITA targeting sequence
aauauuucaccccaaucuua

SEQ ID NO: 40642 - RNA, 20 nt, Artificial Sequence
  CIITA targeting sequence
ucaaauauuucaccccaauc

SEQ ID NO: 40643 - RNA, 20 nt, Artificial Sequence
  CIITA targeting sequence
ccucaaauauuucaccccaa

SEQ ID NO: 40644 - RNA, 20 nt, Artificial Sequence
  CIITA targeting sequence
agacuuaagggugaagggau

SEQ ID NO: 40645 - RNA, 20 nt, Artificial Sequence
  CIITA targeting sequence
ugaucuccucaaauauuuca

SEQ ID NO: 40646 - RNA, 20 nt, Artificial Sequence
  CIITA targeting sequence
cccuuaagucuugaucuccu

SEQ ID NO: 40647 - RNA, 20 nt, Artificial Sequence
  CIITA targeting sequence
cuucacccuuaagucuugau

SEQ ID NO: 40648 - RNA, 20 nt, Artificial Sequence
  CIITA targeting sequence
cugcuaaaggccuuggcaaa

SEQ ID NO: 40649 - RNA, 20 nt, Artificial Sequence
  CIITA targeting sequence
ggcauuuggcucccugcuaa

SEQ ID NO: 40650 - RNA, 20 nt, Artificial Sequence
  CIITA targeting sequence
uggagucaaacucugauccu

SEQ ID NO: 40651 - RNA, 20 nt, Artificial Sequence
  CIITA targeting sequence
aggaucuggcauuuggcucc

SEQ ID NO: 40652 - RNA, 20 nt, Artificial Sequence
  CIITA targeting sequence
aacucugauccuguggccuu

SEQ ID NO: 40653 - RNA, 20 nt, Artificial Sequence
  CIITA targeting sequence
gauccuguggccuuuugcug

SEQ ID NO: 40654 - RNA, 20 nt, Artificial Sequence
  CIITA targeting sequence
gaguuugacuccaggaucug

SEQ ID NO: 40655 - RNA, 20 nt, Artificial Sequence
  CIITA targeting sequence
uguggccuuuugcugaggcc

SEQ ID NO: 40656 - RNA, 20 nt, Artificial Sequence
  CIITA targeting sequence
gcaaaaggccacaggaucag

SEQ ID NO: 40657 - RNA, 20 nt, Artificial Sequence
  CIITA targeting sequence
cagacuucaggauuucagag

SEQ ID NO: 40658 - RNA, 20 nt, Artificial Sequence
  CIITA targeting sequence
gacuucaggauuucagaggc

SEQ ID NO: 40659 - RNA, 20 nt, Artificial Sequence
  CIITA targeting sequence
gagaacacuggccucagcaa

SEQ ID NO: 40660 - RNA, 20 nt, Artificial Sequence
  CIITA targeting sequence
ggauuucagaggccgagaac

SEQ ID NO: 40661 - RNA, 20 nt, Artificial Sequence
  CIITA targeting sequence
ugaagucugagaacacuggc

SEQ ID NO: 40662 - RNA, 20 nt, Artificial Sequence
  CIITA targeting sequence
gaggccgagaacauuucgga

SEQ ID NO: 40663 - RNA, 20 nt, Artificial Sequence
  CIITA targeting sequence
gaaauccugaagucugagaa

SEQ ID NO: 40664 - RNA, 20 nt, Artificial Sequence
  CIITA targeting sequence
gccucugaaauccugaaguc

SEQ ID NO: 40665 - RNA, 20 nt, Artificial Sequence
  CIITA targeting sequence
cggccucugaaauccugaag

SEQ ID NO: 40666 - RNA, 20 nt, Artificial Sequence
  CIITA targeting sequence
gaaugaauucgagugaccgu

SEQ ID NO: 40667 - RNA, 20 nt, Artificial Sequence
  CIITA targeting sequence
gaaauguucucggccucuga

SEQ ID NO: 40668 - RNA, 20 nt, Artificial Sequence
  CIITA targeting sequence
uuccgaaauguucucggccu

SEQ ID NO: 40669 - RNA, 20 nt, Artificial Sequence
  CIITA targeting sequence
agugaccgugcgcgguuacu

SEQ ID NO: 40670 - RNA, 20 nt, Artificial Sequence
  CIITA targeting sequence
aauucauuccgaaauguucu

SEQ ID NO: 40671 - RNA, 20 nt, Artificial Sequence
  CIITA targeting sequence
cucgaauucauuccgaaaug

SEQ ID NO: 40672 - RNA, 20 nt, Artificial Sequence
  CIITA targeting sequence
aggaugcucauucaaacaaa

SEQ ID NO: 40673 - RNA, 20 nt, Artificial Sequence
  CIITA targeting sequence
uugauaaacauuaaaaaaca

SEQ ID NO: 40674 - RNA, 20 nt, Artificial Sequence
  CIITA targeting sequence
uucaaacaaacaaauaacaa

SEQ ID NO: 40675 - RNA, 20 nt, Artificial Sequence
  CIITA targeting sequence
aacaaacaaauaacaacaaa

SEQ ID NO: 40676 - RNA, 20 nt, Artificial Sequence
  CIITA targeting sequence
uugguaaaauuauggugcca

SEQ ID NO: 40677 - RNA, 20 nt, Artificial Sequence
  CIITA targeting sequence
uucuuugguaaaauuauggu

SEQ ID NO: 40678 - RNA, 20 nt, Artificial Sequence
  CIITA targeting sequence
uucuaauauugaaaaaguuc

SEQ ID NO: 40679 - RNA, 20 nt, Artificial Sequence
  CIITA targeting sequence
aauauugaaaaaguucaaag

SEQ ID NO: 40680 - RNA, 20 nt, Artificial Sequence
  CIITA targeting sequence
auauuagaaugaucauucuu

SEQ ID NO: 40681 - RNA, 20 nt, Artificial Sequence
  CIITA targeting sequence
aaggacauaauugcagaaua

SEQ ID NO: 40682 - RNA, 20 nt, Artificial Sequence
  CIITA targeting sequence
uuugaacuuuuucaauauua

SEQ ID NO: 40683 - RNA, 20 nt, Artificial Sequence
  CIITA targeting sequence
gcaauuauguccuuugaacu

SEQ ID NO: 40684 - RNA, 20 nt, Artificial Sequence
  CIITA targeting sequence
uuuauucugcaauuaugucc

SEQ ID NO: 40685 - RNA, 20 nt, Artificial Sequence
  CIITA targeting sequence
uuauauggaaugcauuuaac

SEQ ID NO: 40686 - RNA, 20 nt, Artificial Sequence
  CIITA targeting sequence
auauaaagagcugucuuuua

SEQ ID NO: 40687 - RNA, 20 nt, Artificial Sequence
  CIITA targeting sequence
uuguccuuauuuuucucauc

SEQ ID NO: 40688 - RNA, 20 nt, Artificial Sequence
  CIITA targeting sequence
uuauuuuucucauccccuug

SEQ ID NO: 40689 - RNA, 20 nt, Artificial Sequence
  CIITA targeting sequence
cauccccuugaagucugcuc

SEQ ID NO: 40690 - RNA, 20 nt, Artificial Sequence
  CIITA targeting sequence
uccccuugaagucugcucua

SEQ ID NO: 40691 - RNA, 20 nt, Artificial Sequence
  CIITA targeting sequence
ccuugaagucugcucuaaau

SEQ ID NO: 40692 - RNA, 20 nt, Artificial Sequence
  CIITA targeting sequence
aggggaugagaaaaauaagg

SEQ ID NO: 40693 - RNA, 20 nt, Artificial Sequence
  CIITA targeting sequence
gcucuaaauguugauccagg

SEQ ID NO: 40694 - RNA, 20 nt, Artificial Sequence
  CIITA targeting sequence
aaauguugauccaggcugug

SEQ ID NO: 40695 - RNA, 20 nt, Artificial Sequence
  CIITA targeting sequence
acauuuagagcagacuucaa

SEQ ID NO: 40696 - RNA, 20 nt, Artificial Sequence
  CIITA targeting sequence
aggcugugugacccugugug

SEQ ID NO: 40697 - RNA, 20 nt, Artificial Sequence
  CIITA targeting sequence
cacagccuggaucaacauuu

SEQ ID NO: 40698 - RNA, 20 nt, Artificial Sequence
  CIITA targeting sequence
cacagggucacacagccugg

SEQ ID NO: 40699 - RNA, 20 nt, Artificial Sequence
  CIITA targeting sequence
aauagcucacacagggucac

SEQ ID NO: 40700 - RNA, 20 nt, Artificial Sequence
  CIITA targeting sequence
ccuagugccucaguuucccu

SEQ ID NO: 40701 - RNA, 20 nt, Artificial Sequence
  CIITA targeting sequence
guuucccuauauguaaaaug

SEQ ID NO: 40702 - RNA, 20 nt, Artificial Sequence
  CIITA targeting sequence
cuauauguaaaauggagaua

SEQ ID NO: 40703 - RNA, 20 nt, Artificial Sequence
  CIITA targeting sequence
auuuuacauauagggaaacu

SEQ ID NO: 40704 - RNA, 20 nt, Artificial Sequence
  CIITA targeting sequence
ccauuuuacauauagggaaa

SEQ ID NO: 40705 - RNA, 20 nt, Artificial Sequence
  CIITA targeting sequence
uaucuccauuuuacauauag

SEQ ID NO: 40706 - RNA, 20 nt, Artificial Sequence
  CIITA targeting sequence
gagucuugaggaguaaauga

SEQ ID NO: 40707 - RNA, 20 nt, Artificial Sequence
  CIITA targeting sequence
gagcuaugggcucuuaucuc

SEQ ID NO: 40708 - RNA, 20 nt, Artificial Sequence
  CIITA targeting sequence
ugaggaguaaaugagaucua

SEQ ID NO: 40709 - RNA, 20 nt, Artificial Sequence
  CIITA targeting sequence
agacucugagcuaugggcuc

SEQ ID NO: 40710 - RNA, 20 nt, Artificial Sequence
  CIITA targeting sequence
ucaagacucugagcuauggg

SEQ ID NO: 40711 - RNA, 20 nt, Artificial Sequence
  CIITA targeting sequence
uuuacuccucaagacucuga

SEQ ID NO: 40712 - RNA, 20 nt, Artificial Sequence
  CIITA targeting sequence
cauuuacuccucaagacucu

SEQ ID NO: 40713 - RNA, 20 nt, Artificial Sequence
  CIITA targeting sequence
aggccgagggaagggccuag

SEQ ID NO: 40714 - RNA, 20 nt, Artificial Sequence
  CIITA targeting sequence
gccuagaucucauuuacucc

SEQ ID NO: 40715 - RNA, 20 nt, Artificial Sequence
  CIITA targeting sequence
cucggccuagaucucauuua

SEQ ID NO: 40716 - RNA, 20 nt, Artificial Sequence
  CIITA targeting sequence
acaaaugguuccuuuuguua

SEQ ID NO: 40717 - RNA, 20 nt, Artificial Sequence
  CIITA targeting sequence
uuuuguuauuaaaaugcaaa

SEQ ID NO: 40718 - RNA, 20 nt, Artificial Sequence
  CIITA targeting sequence
accaccugguuuaccacugg

SEQ ID NO: 40719 - RNA, 20 nt, Artificial Sequence
  CIITA targeting sequence
ucagcuggcauuucaggacc

SEQ ID NO: 40720 - RNA, 20 nt, Artificial Sequence
  CIITA targeting sequence
gcuggcauuucaggaccccu

SEQ ID NO: 40721 - RNA, 20 nt, Artificial Sequence
  CIITA targeting sequence
ggaccccuuccccaggcugc

SEQ ID NO: 40722 - RNA, 20 nt, Artificial Sequence
  CIITA targeting sequence
ugaaaugccagcugacgacc

SEQ ID NO: 40723 - RNA, 20 nt, Artificial Sequence
  CIITA targeting sequence
ccaggcugcggcgggagaag

SEQ ID NO: 40724 - RNA, 20 nt, Artificial Sequence
  CIITA targeting sequence
cgccgcagccuggggaaggg

SEQ ID NO: 40725 - RNA, 20 nt, Artificial Sequence
  CIITA targeting sequence
cccgccgcagccuggggaag

SEQ ID NO: 40726 - RNA, 20 nt, Artificial Sequence
  CIITA targeting sequence
guggauguugggaagaguaa

SEQ ID NO: 40727 - RNA, 20 nt, Artificial Sequence
  CIITA targeting sequence
acagauacccuucucccgcc

SEQ ID NO: 40728 - RNA, 20 nt, Artificial Sequence
  CIITA targeting sequence
caacauccacagauacccuu

SEQ ID NO: 40729 - RNA, 20 nt, Artificial Sequence
  CIITA targeting sequence
ucccaacauccacagauacc

SEQ ID NO: 40730 - RNA, 20 nt, Artificial Sequence
  CIITA targeting sequence
uacucuucccaacauccaca

SEQ ID NO: 40731 - RNA, 20 nt, Artificial Sequence
  CIITA targeting sequence
cuacuuagagacaaaagcug

SEQ ID NO: 40732 - RNA, 20 nt, Artificial Sequence
  CIITA targeting sequence
aaguagggagccaguucuua

SEQ ID NO: 40733 - RNA, 20 nt, Artificial Sequence
  CIITA targeting sequence
cuaaguagggagccaguucu

SEQ ID NO: 40734 - RNA, 20 nt, Artificial Sequence
  CIITA targeting sequence
ccagcuuuugucucuaagua

SEQ ID NO: 40735 - RNA, 20 nt, Artificial Sequence
  CIITA targeting sequence
uggggcuccccagcuuuugu

SEQ ID NO: 40736 - RNA, 20 nt, Artificial Sequence
  CIITA targeting sequence
caucuuggggcuccccagcu

SEQ ID NO: 40737 - RNA, 20 nt, Artificial Sequence
  CIITA targeting sequence
uuuucuuuucuuuuuuuguu

SEQ ID NO: 40738 - RNA, 20 nt, Artificial Sequence
  CIITA targeting sequence
uuucuuuuuuuguuuuuuuu

SEQ ID NO: 40739 - RNA, 20 nt, Artificial Sequence
  CIITA targeting sequence
uuuuuuguuuuuuuucuuuu

SEQ ID NO: 40740 - RNA, 20 nt, Artificial Sequence
  CIITA targeting sequence
uuuuugagacagggucucgc

SEQ ID NO: 40741 - RNA, 20 nt, Artificial Sequence
  CIITA targeting sequence
aaaaagaaaaaaaacaaaaa

SEQ ID NO: 40742 - RNA, 20 nt, Artificial Sequence
  CIITA targeting sequence
caaaaaagaaaaaaaacaaa

SEQ ID NO: 40743 - RNA, 20 nt, Artificial Sequence
  CIITA targeting sequence
cgcucuuacccaggcuggag

SEQ ID NO: 40744 - RNA, 20 nt, Artificial Sequence
  CIITA targeting sequence
cucuuacccaggcuggagug

SEQ ID NO: 40745 - RNA, 20 nt, Artificial Sequence
  CIITA targeting sequence
uacccaggcuggagugcagu

SEQ ID NO: 40746 - RNA, 20 nt, Artificial Sequence
  CIITA targeting sequence
agccuggguaagagcgagac

SEQ ID NO: 40747 - RNA, 20 nt, Artificial Sequence
  CIITA targeting sequence
caccacugcacuccagccug

SEQ ID NO: 40748 - RNA, 20 nt, Artificial Sequence
  CIITA targeting sequence
uggcucacugcauccuccac

SEQ ID NO: 40749 - RNA, 20 nt, Artificial Sequence
  CIITA targeting sequence
cugcauccuccaccuccugg

SEQ ID NO: 40750 - RNA, 20 nt, Artificial Sequence
  CIITA targeting sequence
uccaccuccugggcucaagc

SEQ ID NO: 40751 - RNA, 20 nt, Artificial Sequence
  CIITA targeting sequence
accuccugggcucaagcgau

SEQ ID NO: 40752 - RNA, 20 nt, Artificial Sequence
  CIITA targeting sequence
ugggcucaagcgaugcuucc

SEQ ID NO: 40753 - RNA, 20 nt, Artificial Sequence
  CIITA targeting sequence
agcgaugcuuccaccucagc

SEQ ID NO: 40754 - RNA, 20 nt, Artificial Sequence
  CIITA targeting sequence
cuugagcccaggagguggag

SEQ ID NO: 40755 - RNA, 20 nt, Artificial Sequence
  CIITA targeting sequence
accucagccuccuaagaagc

SEQ ID NO: 40756 - RNA, 20 nt, Artificial Sequence
  CIITA targeting sequence
gccuccuaagaagcugagac

SEQ ID NO: 40757 - RNA, 20 nt, Artificial Sequence
  CIITA targeting sequence
uaagaagcugagaccacagg

SEQ ID NO: 40758 - RNA, 20 nt, Artificial Sequence
  CIITA targeting sequence
uaggaggcugagguggaagc

SEQ ID NO: 40759 - RNA, 20 nt, Artificial Sequence
  CIITA targeting sequence
gcuucuuaggaggcugaggu

SEQ ID NO: 40760 - RNA, 20 nt, Artificial Sequence
  CIITA targeting sequence
cagcuucuuaggaggcugag

SEQ ID NO: 40761 - RNA, 20 nt, Artificial Sequence
  CIITA targeting sequence
uguggucucagcuucuuagg

SEQ ID NO: 40762 - RNA, 20 nt, Artificial Sequence
  CIITA targeting sequence
acaaaaaacacaauaauuag

SEQ ID NO: 40763 - RNA, 20 nt, Artificial Sequence
  CIITA targeting sequence
cuacaaaaaacacaauaauu

SEQ ID NO: 40764 - RNA, 20 nt, Artificial Sequence
  CIITA targeting sequence
gucucuacaaaaaacacaau

SEQ ID NO: 40765 - RNA, 20 nt, Artificial Sequence
  CIITA targeting sequence
cacuauguugcccaagcugg

SEQ ID NO: 40766 - RNA, 20 nt, Artificial Sequence
  CIITA targeting sequence
cuauguugcccaagcugguc

SEQ ID NO: 40767 - RNA, 20 nt, Artificial Sequence
  CIITA targeting sequence
ugaacuccugggcucaagca

SEQ ID NO: 40768 - RNA, 20 nt, Artificial Sequence
  CIITA targeting sequence
agaccagcuugggcaacaua

SEQ ID NO: 40769 - RNA, 20 nt, Artificial Sequence
  CIITA targeting sequence
ugggcucaagcaguccucuu

SEQ ID NO: 40770 - RNA, 20 nt, Artificial Sequence
  CIITA targeting sequence
agcaguccucuuaccuuggc

SEQ ID NO: 40771 - RNA, 20 nt, Artificial Sequence
  CIITA targeting sequence
ucuuaccuuggccucccaaa

SEQ ID NO: 40772 - RNA, 20 nt, Artificial Sequence
  CIITA targeting sequence
uaccuuggccucccaaaaug

SEQ ID NO: 40773 - RNA, 20 nt, Artificial Sequence
  CIITA targeting sequence
caaaaugcuggaauuacaga

SEQ ID NO: 40774 - RNA, 20 nt, Artificial Sequence
  CIITA targeting sequence
agcauuuugggaggccaagg

SEQ ID NO: 40775 - RNA, 20 nt, Artificial Sequence
  CIITA targeting sequence
guaauuccagcauuuuggga

SEQ ID NO: 40776 - RNA, 20 nt, Artificial Sequence
  CIITA targeting sequence
ugucuguaauuccagcauuu

SEQ ID NO: 40777 - RNA, 20 nt, Artificial Sequence
  CIITA targeting sequence
cagccucaacuggccucuua

SEQ ID NO: 40778 - RNA, 20 nt, Artificial Sequence
  CIITA targeting sequence
acuggccucuuauggggggc

SEQ ID NO: 40779 - RNA, 20 nt, Artificial Sequence
  CIITA targeting sequence
uauggggggcuaugaaaucu

SEQ ID NO: 40780 - RNA, 20 nt, Artificial Sequence
  CIITA targeting sequence
uagccccccauaagaggcca

SEQ ID NO: 40781 - RNA, 20 nt, Artificial Sequence
  CIITA targeting sequence
accccaagcagaaaagauug

SEQ ID NO: 40782 - RNA, 20 nt, Artificial Sequence
  CIITA targeting sequence
gcuugggguagauuucauag

SEQ ID NO: 40783 - RNA, 20 nt, Artificial Sequence
  CIITA targeting sequence
uuucugcuugggguagauuu

SEQ ID NO: 40784 - RNA, 20 nt, Artificial Sequence
  CIITA targeting sequence
uacguggaaggguugcaggg

SEQ ID NO: 40785 - RNA, 20 nt, Artificial Sequence
  CIITA targeting sequence
acguaggaccccaaucuuuu

SEQ ID NO: 40786 - RNA, 20 nt, Artificial Sequence
  CIITA targeting sequence
cugcaacccuuccacguagg

SEQ ID NO: 40787 - RNA, 20 nt, Artificial Sequence
  CIITA targeting sequence
uaggucccugcaacccuucc

SEQ ID NO: 40788 - RNA, 20 nt, Artificial Sequence
  CIITA targeting sequence
accccagccucuuagguccc

SEQ ID NO: 40789 - RNA, 20 nt, Artificial Sequence
  CIITA targeting sequence
cuuccaccccagccucuuag

SEQ ID NO: 40790 - RNA, 20 nt, Artificial Sequence
  CIITA targeting sequence
ucccuuccaccccagccucu

SEQ ID NO: 40791 - RNA, 20 nt, Artificial Sequence
  CIITA targeting sequence
ucuucccuuccaccccagcc

SEQ ID NO: 40792 - RNA, 20 nt, Artificial Sequence
  CIITA targeting sequence
gacaggaccugacuucugug

SEQ ID NO: 40793 - RNA, 20 nt, Artificial Sequence
  CIITA targeting sequence
gaggccccuccucuucccuu

SEQ ID NO: 40794 - RNA, 20 nt, Artificial Sequence
  CIITA targeting sequence
ugucugaggccccuccucuu

SEQ ID NO: 40795 - RNA, 20 nt, Artificial Sequence
  CIITA targeting sequence
gguccugucugaggccccuc

SEQ ID NO: 40796 - RNA, 20 nt, Artificial Sequence
  CIITA targeting sequence
gugccuugucucugccccac

SEQ ID NO: 40797 - RNA, 20 nt, Artificial Sequence
  CIITA targeting sequence
cugccccacccuggggcuga

SEQ ID NO: 40798 - RNA, 20 nt, Artificial Sequence
  CIITA targeting sequence
gccccacccuggggcugaau

SEQ ID NO: 40799 - RNA, 20 nt, Artificial Sequence
  CIITA targeting sequence
gccccaggguggggcagaga

SEQ ID NO: 40800 - RNA, 20 nt, Artificial Sequence
  CIITA targeting sequence
uucagccccaggguggggca

SEQ ID NO: 40801 - RNA, 20 nt, Artificial Sequence
  CIITA targeting sequence
cagccccucauucagcccca

SEQ ID NO: 40802 - RNA, 20 nt, Artificial Sequence
  CIITA targeting sequence
cagucacagccccucauuca

SEQ ID NO: 40803 - RNA, 20 nt, Artificial Sequence
  CIITA targeting sequence
agucacagucacagccccuc

SEQ ID NO: 40804 - RNA, 20 nt, Artificial Sequence
  CIITA targeting sequence
uacccuugcucuuugccucc

SEQ ID NO: 40805 - RNA, 20 nt, Artificial Sequence
  CIITA targeting sequence
uugccuccuaggcugggccc

SEQ ID NO: 40806 - RNA, 20 nt, Artificial Sequence
  CIITA targeting sequence
uaggcugggcccugucucag

SEQ ID NO: 40807 - RNA, 20 nt, Artificial Sequence
  CIITA targeting sequence
caggcccccaggcuuucccc

SEQ ID NO: 40808 - RNA, 20 nt, Artificial Sequence
  CIITA targeting sequence
ggcccccaggcuuuccccaa

SEQ ID NO: 40809 - RNA, 20 nt, Artificial Sequence
  CIITA targeting sequence
ccaaacuggugcggauccuc

SEQ ID NO: 40810 - RNA, 20 nt, Artificial Sequence
  CIITA targeting sequence
gcaccaguuuggggaaagcc

SEQ ID NO: 40811 - RNA, 20 nt, Artificial Sequence
  CIITA targeting sequence
ucacggccuuuuccucccug

SEQ ID NO: 40812 - RNA, 20 nt, Artificial Sequence
  CIITA targeting sequence
cggccuuuuccucccugcag

SEQ ID NO: 40813 - RNA, 20 nt, Artificial Sequence
  CIITA targeting sequence
ucccugcagcaucuggagug

SEQ ID NO: 40814 - RNA, 20 nt, Artificial Sequence
  CIITA targeting sequence
cugcagcaucuggagugagu

SEQ ID NO: 40815 - RNA, 20 nt, Artificial Sequence
  CIITA targeting sequence
ggagugaguauagacucugg

SEQ ID NO: 40816 - RNA, 20 nt, Artificial Sequence
  CIITA targeting sequence
agaugcugcagggaggaaaa

SEQ ID NO: 40817 - RNA, 20 nt, Artificial Sequence
  CIITA targeting sequence
cuccagaugcugcagggagg

SEQ ID NO: 40818 - RNA, 20 nt, Artificial Sequence
  CIITA targeting sequence
auacucacuccagaugcugc

SEQ ID NO: 40819 - RNA, 20 nt, Artificial Sequence
  CIITA targeting sequence
gggaccccuuccucucaaca

SEQ ID NO: 40820 - RNA, 20 nt, Artificial Sequence
  CIITA targeting sequence
cagagucuauacucacucca

SEQ ID NO: 40821 - RNA, 20 nt, Artificial Sequence
  CIITA targeting sequence
ucucaacaucugggugcagu

SEQ ID NO: 40822 - RNA, 20 nt, Artificial Sequence
  CIITA targeting sequence
caacaucugggugcagugcu

SEQ ID NO: 40823 - RNA, 20 nt, Artificial Sequence
  CIITA targeting sequence
acaucugggugcagugcugu

SEQ ID NO: 40824 - RNA, 20 nt, Artificial Sequence
  CIITA targeting sequence
gggugcagugcugugaucau

SEQ ID NO: 40825 - RNA, 20 nt, Artificial Sequence
  CIITA targeting sequence
cagcacugcacccagauguu

SEQ ID NO: 40826 - RNA, 20 nt, Artificial Sequence
  CIITA targeting sequence
uagcucacugcagccucgaa

SEQ ID NO: 40827 - RNA, 20 nt, Artificial Sequence
  CIITA targeting sequence
cugcagccucgaauuccugg

SEQ ID NO: 40828 - RNA, 20 nt, Artificial Sequence
  CIITA targeting sequence
aauuccuggccucaaguagu

SEQ ID NO: 40829 - RNA, 20 nt, Artificial Sequence
  CIITA targeting sequence
aggcugcagugagcuaugau

SEQ ID NO: 40830 - RNA, 20 nt, Artificial Sequence
  CIITA targeting sequence
uggccucaaguaguccuccu

SEQ ID NO: 40831 - RNA, 20 nt, Artificial Sequence
  CIITA targeting sequence
aguaguccuccugccucagc

SEQ ID NO: 40832 - RNA, 20 nt, Artificial Sequence
  CIITA targeting sequence
uccugccucagccuccugag

SEQ ID NO: 40833 - RNA, 20 nt, Artificial Sequence
  CIITA targeting sequence
ugccucagccuccugaguag

SEQ ID NO: 40834 - RNA, 20 nt, Artificial Sequence
  CIITA targeting sequence
gccuccugaguagcugggac

SEQ ID NO: 40835 - RNA, 20 nt, Artificial Sequence
  CIITA targeting sequence
ugaguagcugggaccacagg

SEQ ID NO: 40836 - RNA, 20 nt, Artificial Sequence
  CIITA targeting sequence
ggaggcugaggcaggaggac

SEQ ID NO: 40837 - RNA, 20 nt, Artificial Sequence
  CIITA targeting sequence
cagcuacucaggaggcugag

SEQ ID NO: 40838 - RNA, 20 nt, Artificial Sequence
  CIITA targeting sequence
ggguuuugacaaccccaaau

SEQ ID NO: 40839 - RNA, 20 nt, Artificial Sequence
  CIITA targeting sequence
aaacccagagguugcugggc

SEQ ID NO: 40840 - RNA, 20 nt, Artificial Sequence
  CIITA targeting sequence
ugcccccaaggcaccugcag

SEQ ID NO: 40841 - RNA, 20 nt, Artificial Sequence
  CIITA targeting sequence
gcaggugccuugggggcagg

SEQ ID NO: 40842 - RNA, 20 nt, Artificial Sequence
  CIITA targeting sequence
uucugcaggugccuuggggg

SEQ ID NO: 40843 - RNA, 20 nt, Artificial Sequence
  CIITA targeting sequence
cuuugucccuuuuuuucucu

SEQ ID NO: 40844 - RNA, 20 nt, Artificial Sequence
  CIITA targeting sequence
cuuuuuuucucucuuccgcc

SEQ ID NO: 40845 - RNA, 20 nt, Artificial Sequence
  CIITA targeting sequence
cucuuccgccuacugcaucc

SEQ ID NO: 40846 - RNA, 20 nt, Artificial Sequence
  CIITA targeting sequence
cuuccgccuacugcauccuc

SEQ ID NO: 40847 - RNA, 20 nt, Artificial Sequence
  CIITA targeting sequence
uccgccuacugcauccucaa

SEQ ID NO: 40848 - RNA, 20 nt, Artificial Sequence
  CIITA targeting sequence
gccuacugcauccucaaugu

SEQ ID NO: 40849 - RNA, 20 nt, Artificial Sequence
  CIITA targeting sequence
ucaauguggcuggcacauga

SEQ ID NO: 40850 - RNA, 20 nt, Artificial Sequence
  CIITA targeting sequence
auguggcuggcacaugagug

SEQ ID NO: 40851 - RNA, 20 nt, Artificial Sequence
  CIITA targeting sequence
ugugccagccacauugagga

SEQ ID NO: 40852 - RNA, 20 nt, Artificial Sequence
  CIITA targeting sequence
cucaugugccagccacauug

SEQ ID NO: 40853 - RNA, 20 nt, Artificial Sequence
  CIITA targeting sequence
ucacucaugugccagccaca

SEQ ID NO: 40854 - RNA, 20 nt, Artificial Sequence
  CIITA targeting sequence
caucacucaugugccagcca

SEQ ID NO: 40855 - RNA, 20 nt, Artificial Sequence
  CIITA targeting sequence
ucucaucacucaugugccag

SEQ ID NO: 40856 - RNA, 20 nt, Artificial Sequence
  CIITA targeting sequence
gaugggaauccccagugaca

SEQ ID NO: 40857 - RNA, 20 nt, Artificial Sequence
  CIITA targeting sequence
gauguggcgucaucucauca

SEQ ID NO: 40858 - RNA, 20 nt, Artificial Sequence
  CIITA targeting sequence
caucugauguggcgucaucu

SEQ ID NO: 40859 - RNA, 20 nt, Artificial Sequence
  CIITA targeting sequence
ccagugacaaaaaaaguugu

SEQ ID NO: 40860 - RNA, 20 nt, Artificial Sequence
  CIITA targeting sequence
cuggggauucccaucugaug

SEQ ID NO: 40861 - RNA, 20 nt, Artificial Sequence
  CIITA targeting sequence
acaacuuuuuuugucacugg

SEQ ID NO: 40862 - RNA, 20 nt, Artificial Sequence
  CIITA targeting sequence
uuucgugaccuuugaaacuc

SEQ ID NO: 40863 - RNA, 20 nt, Artificial Sequence
  CIITA targeting sequence
ugaccuuugaaacuccuuuc

SEQ ID NO: 40864 - RNA, 20 nt, Artificial Sequence
  CIITA targeting sequence
cgaaaggaucuacaacuuuu

SEQ ID NO: 40865 - RNA, 20 nt, Artificial Sequence
  CIITA targeting sequence
aaggucacgaaaggaucuac

SEQ ID NO: 40866 - RNA, 20 nt, Artificial Sequence
  CIITA targeting sequence
uuuccucacaaccucauuug

SEQ ID NO: 40867 - RNA, 20 nt, Artificial Sequence
  CIITA targeting sequence
ucacaaccucauuugcugcu

SEQ ID NO: 40868 - RNA, 20 nt, Artificial Sequence
  CIITA targeting sequence
caaccucauuugcugcucuc

SEQ ID NO: 40869 - RNA, 20 nt, Artificial Sequence
  CIITA targeting sequence
uuugcugcucucagcaauuc

SEQ ID NO: 40870 - RNA, 20 nt, Artificial Sequence
  CIITA targeting sequence
cagcaauucagcuggggagg

SEQ ID NO: 40871 - RNA, 20 nt, Artificial Sequence
  CIITA targeting sequence
gcaauucagcuggggaggga

SEQ ID NO: 40872 - RNA, 20 nt, Artificial Sequence
  CIITA targeting sequence
gcuggggagggauuggggag

SEQ ID NO: 40873 - RNA, 20 nt, Artificial Sequence
  CIITA targeting sequence
ccagcugaauugcugagagc

SEQ ID NO: 40874 - RNA, 20 nt, Artificial Sequence
  CIITA targeting sequence
cuccccagcugaauugcuga

SEQ ID NO: 40875 - RNA, 20 nt, Artificial Sequence
  CIITA targeting sequence
ccaaucccuccccagcugaa

SEQ ID NO: 40876 - RNA, 20 nt, Artificial Sequence
  CIITA targeting sequence
uacuuuacaguggagguuaa

SEQ ID NO: 40877 - RNA, 20 nt, Artificial Sequence
  CIITA targeting sequence
acuguaaaguaggacuaugc

SEQ ID NO: 40878 - RNA, 20 nt, Artificial Sequence
  CIITA targeting sequence
uuaaccuccacuguaaagua

SEQ ID NO: 40879 - RNA, 20 nt, Artificial Sequence
  CIITA targeting sequence
ggggcuuaguuccuaagaag

SEQ ID NO: 40880 - RNA, 20 nt, Artificial Sequence
  CIITA targeting sequence
uaagaagcuaaacagggauu

SEQ ID NO: 40881 - RNA, 20 nt, Artificial Sequence
  CIITA targeting sequence
uaggaacuaagccccugagg

SEQ ID NO: 40882 - RNA, 20 nt, Artificial Sequence
  CIITA targeting sequence
cuguuuagcuucuuaggaac

SEQ ID NO: 40883 - RNA, 20 nt, Artificial Sequence
  CIITA targeting sequence
aguccaucaugaguuagacu

SEQ ID NO: 40884 - RNA, 20 nt, Artificial Sequence
  CIITA targeting sequence
aucaugaguuagacuuugcc

SEQ ID NO: 40885 - RNA, 20 nt, Artificial Sequence
  CIITA targeting sequence
ugaguuagacuuugcccucu

SEQ ID NO: 40886 - RNA, 20 nt, Artificial Sequence
  CIITA targeting sequence
ugauggacuugaaucccugu

SEQ ID NO: 40887 - RNA, 20 nt, Artificial Sequence
  CIITA targeting sequence
aacucaugauggacuugaau

SEQ ID NO: 40888 - RNA, 20 nt, Artificial Sequence
  CIITA targeting sequence
ggcugccugguuggagcccc

SEQ ID NO: 40889 - RNA, 20 nt, Artificial Sequence
  CIITA targeting sequence
aaccaggcagccagagggca

SEQ ID NO: 40890 - RNA, 20 nt, Artificial Sequence
  CIITA targeting sequence
ccugggggcuccaaccaggc

SEQ ID NO: 40891 - RNA, 20 nt, Artificial Sequence
  CIITA targeting sequence
ucaccugggggcuccaacca

SEQ ID NO: 40892 - RNA, 20 nt, Artificial Sequence
  CIITA targeting sequence
ucgucugaaaagcucaggaa

SEQ ID NO: 40893 - RNA, 20 nt, Artificial Sequence
  CIITA targeting sequence
ucugaaaagcucaggaaugu

SEQ ID NO: 40894 - RNA, 20 nt, Artificial Sequence
  CIITA targeting sequence
gaaaagcucaggaaugugcc

SEQ ID NO: 40895 - RNA, 20 nt, Artificial Sequence
  CIITA targeting sequence
gacgaggacuucaucaccug

SEQ ID NO: 40896 - RNA, 20 nt, Artificial Sequence
  CIITA targeting sequence
ggaaugugccggcugccuau

SEQ ID NO: 40897 - RNA, 20 nt, Artificial Sequence
  CIITA targeting sequence
ugagcuuuucagacgaggac

SEQ ID NO: 40898 - RNA, 20 nt, Artificial Sequence
  CIITA targeting sequence
aauacaccauaggcagccgg

SEQ ID NO: 40899 - RNA, 20 nt, Artificial Sequence
  CIITA targeting sequence
caccccccagcucuaauaca

SEQ ID NO: 40900 - RNA, 20 nt, Artificial Sequence
  CIITA targeting sequence
gcccuggcaccugcccuucc

SEQ ID NO: 40901 - RNA, 20 nt, Artificial Sequence
  CIITA targeting sequence
ucagcccuggcaccugcccu

SEQ ID NO: 40902 - RNA, 20 nt, Artificial Sequence
  CIITA targeting sequence
cugggaugggaagggucaga

SEQ ID NO: 40903 - RNA, 20 nt, Artificial Sequence
  CIITA targeting sequence
cagugagggccuccucagcc

SEQ ID NO: 40904 - RNA, 20 nt, Artificial Sequence
  CIITA targeting sequence
caucccagugagggccuccu

SEQ ID NO: 40905 - RNA, 20 nt, Artificial Sequence
  CIITA targeting sequence
gauggccccaggacgcuagc

SEQ ID NO: 40906 - RNA, 20 nt, Artificial Sequence
  CIITA targeting sequence
gacccuucccaucccaguga

SEQ ID NO: 40907 - RNA, 20 nt, Artificial Sequence
  CIITA targeting sequence
uggggccaucugacccuucc

SEQ ID NO: 40908 - RNA, 20 nt, Artificial Sequence
  CIITA targeting sequence
gcuagcguccuggggccauc

SEQ ID NO: 40909 - RNA, 20 nt, Artificial Sequence
  CIITA targeting sequence
gauuccaccugcagccugga

SEQ ID NO: 40910 - RNA, 20 nt, Artificial Sequence
  CIITA targeting sequence
gaugggggccaucagcuagc

SEQ ID NO: 40911 - RNA, 20 nt, Artificial Sequence
  CIITA targeting sequence
accugcagccuggaugcgcu

SEQ ID NO: 40912 - RNA, 20 nt, Artificial Sequence
  CIITA targeting sequence
aggcugcagguggaaucaga

SEQ ID NO: 40913 - RNA, 20 nt, Artificial Sequence
  CIITA targeting sequence
gcgcauccaggcugcaggug

SEQ ID NO: 40914 - RNA, 20 nt, Artificial Sequence
  CIITA targeting sequence
cucagcgcauccaggcugca

SEQ ID NO: 40915 - RNA, 20 nt, Artificial Sequence
  CIITA targeting sequence
cacucagcgcauccaggcug

SEQ ID NO: 40916 - RNA, 20 nt, Artificial Sequence
  CIITA targeting sequence
uguucucacucagcgcaucc

SEQ ID NO: 40917 - RNA, 20 nt, Artificial Sequence
  CIITA targeting sequence
gggacgagggugucucgcag

SEQ ID NO: 40918 - RNA, 20 nt, Artificial Sequence
  CIITA targeting sequence
ccgaucuuguucucacucag

SEQ ID NO: 40919 - RNA, 20 nt, Artificial Sequence
  CIITA targeting sequence
uccccgaucuuguucucacu

SEQ ID NO: 40920 - RNA, 20 nt, Artificial Sequence
  CIITA targeting sequence
cgcagcucucagccaccuuc

SEQ ID NO: 40921 - RNA, 20 nt, Artificial Sequence
  CIITA targeting sequence
cagcucucagccaccuuccc

SEQ ID NO: 40922 - RNA, 20 nt, Artificial Sequence
  CIITA targeting sequence
cagccaccuucccccagcug

SEQ ID NO: 40923 - RNA, 20 nt, Artificial Sequence
  CIITA targeting sequence
gccaccuucccccagcugaa

SEQ ID NO: 40924 - RNA, 20 nt, Artificial Sequence
  CIITA targeting sequence
cccagcugaaguccuuggaa

SEQ ID NO: 40925 - RNA, 20 nt, Artificial Sequence
  CIITA targeting sequence
gcugggggaagguggcugag

SEQ ID NO: 40926 - RNA, 20 nt, Artificial Sequence
  CIITA targeting sequence
uuggaaacccucaagugagu

SEQ ID NO: 40927 - RNA, 20 nt, Artificial Sequence
  CIITA targeting sequence
aaggacuucagcugggggaa

SEQ ID NO: 40928 - RNA, 20 nt, Artificial Sequence
  CIITA targeting sequence
agugagugagcugggccugc

SEQ ID NO: 40929 - RNA, 20 nt, Artificial Sequence
  CIITA targeting sequence
cuugaggguuuccaaggacu

SEQ ID NO: 40930 - RNA, 20 nt, Artificial Sequence
  CIITA targeting sequence
cucacuugaggguuuccaag

SEQ ID NO: 40931 - RNA, 20 nt, Artificial Sequence
  CIITA targeting sequence
ugcugaaucgggcccccaaa

SEQ ID NO: 40932 - RNA, 20 nt, Artificial Sequence
  CIITA targeting sequence
gcaggaagggcaggcccagc

SEQ ID NO: 40933 - RNA, 20 nt, Artificial Sequence
  CIITA targeting sequence
ggcccccaaaguccggcuga

SEQ ID NO: 40934 - RNA, 20 nt, Artificial Sequence
  CIITA targeting sequence
ggcugacuuuuucaaaauua

SEQ ID NO: 40935 - RNA, 20 nt, Artificial Sequence
  CIITA targeting sequence
gccggacuuugggggcccga

SEQ ID NO: 40936 - RNA, 20 nt, Artificial Sequence
  CIITA targeting sequence
aaauuaauuuaaauuuguuu

SEQ ID NO: 40937 - RNA, 20 nt, Artificial Sequence
  CIITA targeting sequence
aaaaaaacaaauuuaaauua

SEQ ID NO: 40938 - RNA, 20 nt, Artificial Sequence
  CIITA targeting sequence
cugugucacccaggcuagaa

SEQ ID NO: 40939 - RNA, 20 nt, Artificial Sequence
  CIITA targeting sequence
cccaggcuagaauauagugc

SEQ ID NO: 40940 - RNA, 20 nt, Artificial Sequence
  CIITA targeting sequence
agccugggugacacagcgag

SEQ ID NO: 40941 - RNA, 20 nt, Artificial Sequence
  CIITA targeting sequence
uagcacuauauucuagccug

SEQ ID NO: 40942 - RNA, 20 nt, Artificial Sequence
  CIITA targeting sequence
uaccucugcagccuugaacu

SEQ ID NO: 40943 - RNA, 20 nt, Artificial Sequence
  CIITA targeting sequence
gcagccuugaacuccuggcc

SEQ ID NO: 40944 - RNA, 20 nt, Artificial Sequence
  CIITA targeting sequence
aggcugcagagguaugauca

SEQ ID NO: 40945 - RNA, 20 nt, Artificial Sequence
  CIITA targeting sequence
uggccucaaggaaucuccuc

SEQ ID NO: 40946 - RNA, 20 nt, Artificial Sequence
  CIITA targeting sequence
aggaaucuccucaccuccgc

SEQ ID NO: 40947 - RNA, 20 nt, Artificial Sequence
  CIITA targeting sequence
uugaggccaggaguucaagg

SEQ ID NO: 40948 - RNA, 20 nt, Artificial Sequence
  CIITA targeting sequence
ccucaccuccgcuucccaaa

SEQ ID NO: 40949 - RNA, 20 nt, Artificial Sequence
  CIITA targeting sequence
ucaccuccgcuucccaaagu

SEQ ID NO: 40950 - RNA, 20 nt, Artificial Sequence
  CIITA targeting sequence
ccuccgcuucccaaagugcu

SEQ ID NO: 40951 - RNA, 20 nt, Artificial Sequence
  CIITA targeting sequence
gcuucccaaagugcugggau

SEQ ID NO: 40952 - RNA, 20 nt, Artificial Sequence
  CIITA targeting sequence
caaagugcugggauuauagg

SEQ ID NO: 40953 - RNA, 20 nt, Artificial Sequence
  CIITA targeting sequence
cagcacuuugggaagcggag

SEQ ID NO: 40954 - RNA, 20 nt, Artificial Sequence
  CIITA targeting sequence
caccuauaaucccagcacuu

SEQ ID NO: 40955 - RNA, 20 nt, Artificial Sequence
  CIITA targeting sequence
acuggggcugggcaugguaa

SEQ ID NO: 40956 - RNA, 20 nt, Artificial Sequence
  CIITA targeting sequence
uccauucacucauucaccua

SEQ ID NO: 40957 - RNA, 20 nt, Artificial Sequence
  CIITA targeting sequence
auucacucauucaccuauuc

SEQ ID NO: 40958 - RNA, 20 nt, Artificial Sequence
  CIITA targeting sequence
cucauucaccuauucaauca

SEQ ID NO: 40959 - RNA, 20 nt, Artificial Sequence
  CIITA targeting sequence
uucaccuauucaaucagcca

SEQ ID NO: 40960 - RNA, 20 nt, Artificial Sequence
  CIITA targeting sequence
ccuauucaaucagccauuca

SEQ ID NO: 40961 - RNA, 20 nt, Artificial Sequence
  CIITA targeting sequence
aucagccauucauccuucca

SEQ ID NO: 40962 - RNA, 20 nt, Artificial Sequence
  CIITA targeting sequence
gccauucauccuuccauuca

SEQ ID NO: 40963 - RNA, 20 nt, Artificial Sequence
  CIITA targeting sequence
uccuuccauucaaugauuca

SEQ ID NO: 40964 - RNA, 20 nt, Artificial Sequence
  CIITA targeting sequence
uuccauucaaugauucaucc

SEQ ID NO: 40965 - RNA, 20 nt, Artificial Sequence
  CIITA targeting sequence
auucaaugauucauccauuc

SEQ ID NO: 40966 - RNA, 20 nt, Artificial Sequence
  CIITA targeting sequence
augauucauccauucacuua

SEQ ID NO: 40967 - RNA, 20 nt, Artificial Sequence
  CIITA targeting sequence
uugaauggaaggaugaaugg

SEQ ID NO: 40968 - RNA, 20 nt, Artificial Sequence
  CIITA targeting sequence
uccauucacuuaugcaguca

SEQ ID NO: 40969 - RNA, 20 nt, Artificial Sequence
  CIITA targeting sequence
auucacuuaugcagucauuu

SEQ ID NO: 40970 - RNA, 20 nt, Artificial Sequence
  CIITA targeting sequence
cuuaugcagucauuucuuua

SEQ ID NO: 40971 - RNA, 20 nt, Artificial Sequence
  CIITA targeting sequence
uuucuuuacucccucaucca

SEQ ID NO: 40972 - RNA, 20 nt, Artificial Sequence
  CIITA targeting sequence
uuacucccucauccaaccgc

SEQ ID NO: 40973 - RNA, 20 nt, Artificial Sequence
  CIITA targeting sequence
cucauccaaccgcucacuca

SEQ ID NO: 40974 - RNA, 20 nt, Artificial Sequence
  CIITA targeting sequence
uccaaccgcucacucaauca

SEQ ID NO: 40975 - RNA, 20 nt, Artificial Sequence
  CIITA targeting sequence
aaccgcucacucaaucauuu

SEQ ID NO: 40976 - RNA, 20 nt, Artificial Sequence
  CIITA targeting sequence
cucaaucauuucuuuacuua

SEQ ID NO: 40977 - RNA, 20 nt, Artificial Sequence
  CIITA targeting sequence
aucauuucuuuacuuaccca

SEQ ID NO: 40978 - RNA, 20 nt, Artificial Sequence
  CIITA targeting sequence
uuucuuuacuuacccaacca

SEQ ID NO: 40979 - RNA, 20 nt, Artificial Sequence
  CIITA targeting sequence
uuacuuacccaaccauuuau

SEQ ID NO: 40980 - RNA, 20 nt, Artificial Sequence
  CIITA targeting sequence
acaaauauuuaaggaggacc

SEQ ID NO: 40981 - RNA, 20 nt, Artificial Sequence
  CIITA targeting sequence
uuaaauauuuguugauuaaa

SEQ ID NO: 40982 - RNA, 20 nt, Artificial Sequence
  CIITA targeting sequence
uccuuaaauauuuguugauu

SEQ ID NO: 40983 - RNA, 20 nt, Artificial Sequence
  CIITA targeting sequence
aggcccuggagacccagcuu

SEQ ID NO: 40984 - RNA, 20 nt, Artificial Sequence
  CIITA targeting sequence
agggccuagaaaggugccug

SEQ ID NO: 40985 - RNA, 20 nt, Artificial Sequence
  CIITA targeting sequence
ccagggccuagaaaggugcc

SEQ ID NO: 40986 - RNA, 20 nt, Artificial Sequence
  CIITA targeting sequence
ccugaccucaggaaucuuaa

SEQ ID NO: 40987 - RNA, 20 nt, Artificial Sequence
  CIITA targeting sequence
ggggauuuauuuguuuuguu

SEQ ID NO: 40988 - RNA, 20 nt, Artificial Sequence
  CIITA targeting sequence
ggaaucuuaaauucuaguga

SEQ ID NO: 40989 - RNA, 20 nt, Artificial Sequence
  CIITA targeting sequence
ugaggucaggggauuuauuu

SEQ ID NO: 40990 - RNA, 20 nt, Artificial Sequence
  CIITA targeting sequence
uaaauucuagugaggagaca

SEQ ID NO: 40991 - RNA, 20 nt, Artificial Sequence
  CIITA targeting sequence
agugaggagacacaaugaac

SEQ ID NO: 40992 - RNA, 20 nt, Artificial Sequence
  CIITA targeting sequence
cuagaauuuaagauuccuga

SEQ ID NO: 40993 - RNA, 20 nt, Artificial Sequence
  CIITA targeting sequence
ucacuagaauuuaagauucc

SEQ ID NO: 40994 - RNA, 20 nt, Artificial Sequence
  CIITA targeting sequence
ccucacuagaauuuaagauu

SEQ ID NO: 40995 - RNA, 20 nt, Artificial Sequence
  CIITA targeting sequence
uugugucuccucacuagaau

SEQ ID NO: 40996 - RNA, 20 nt, Artificial Sequence
  CIITA targeting sequence
guaauuauaaaguauacagu

SEQ ID NO: 40997 - RNA, 20 nt, Artificial Sequence
  CIITA targeting sequence
uuacuguauacuuuauaauu

SEQ ID NO: 40998 - RNA, 20 nt, Artificial Sequence
  CIITA targeting sequence
ccaaacauuauuuucauuac

SEQ ID NO: 40999 - RNA, 20 nt, Artificial Sequence
  CIITA targeting sequence
gucaccaaacauuauuuuca

SEQ ID NO: 41000 - RNA, 20 nt, Artificial Sequence
  CIITA targeting sequence
ccccccaguauaauuuucug

SEQ ID NO: 41001 - RNA, 20 nt, Artificial Sequence
  CIITA targeting sequence
uauuucaccccccaguauaa

SEQ ID NO: 41002 - RNA, 20 nt, Artificial Sequence
  CIITA targeting sequence
ccuauuucaccccccaguau

SEQ ID NO: 41003 - RNA, 20 nt, Artificial Sequence
  CIITA targeting sequence
cuccuauuucaccccccagu

SEQ ID NO: 41004 - RNA, 20 nt, Artificial Sequence
  CIITA targeting sequence
aucucuccuauuucaccccc

SEQ ID NO: 41005 - RNA, 20 nt, Artificial Sequence
  CIITA targeting sequence
uaaucuaucucuccuauuuc

SEQ ID NO: 41006 - RNA, 20 nt, Artificial Sequence
  CIITA targeting sequence
auaaagcauuauuaucaaaa

SEQ ID NO: 41007 - RNA, 20 nt, Artificial Sequence
  CIITA targeting sequence
aaacaguaaaacuuuuuaaa

SEQ ID NO: 41008 - RNA, 20 nt, Artificial Sequence
  CIITA targeting sequence
gggcucugggaaguuggaga

SEQ ID NO: 41009 - RNA, 20 nt, Artificial Sequence
  CIITA targeting sequence
gggaaguuggagauggauaa

SEQ ID NO: 41010 - RNA, 20 nt, Artificial Sequence
  CIITA targeting sequence
cagagcccagaacaguuuuu

SEQ ID NO: 41011 - RNA, 20 nt, Artificial Sequence
  CIITA targeting sequence
aacuucccagagcccagaac

SEQ ID NO: 41012 - RNA, 20 nt, Artificial Sequence
  CIITA targeting sequence
ccaacuucccagagcccaga

SEQ ID NO: 41013 - RNA, 20 nt, Artificial Sequence
  CIITA targeting sequence
aucuccaacuucccagagcc

SEQ ID NO: 41014 - RNA, 20 nt, Artificial Sequence
  CIITA targeting sequence
uauccaucuccaacuuccca

SEQ ID NO: 41015 - RNA, 20 nt, Artificial Sequence
  CIITA targeting sequence
uguaucuuauccaucuccaa

SEQ ID NO: 41016 - RNA, 20 nt, Artificial Sequence
  CIITA targeting sequence
uccuguaucuuauccaucuc

SEQ ID NO: 41017 - RNA, 20 nt, Artificial Sequence
  CIITA targeting sequence
augugauuuuuuuucuuuuu

SEQ ID NO: 41018 - RNA, 20 nt, Artificial Sequence
  CIITA targeting sequence
cauugauccuccuguaucuu

SEQ ID NO: 41019 - RNA, 20 nt, Artificial Sequence
  CIITA targeting sequence
uuuuuucagacaaggucucg

SEQ ID NO: 41020 - RNA, 20 nt, Artificial Sequence
  CIITA targeting sequence
gacaaggucucgcucuguca

SEQ ID NO: 41021 - RNA, 20 nt, Artificial Sequence
  CIITA targeting sequence
gaaaaaaagaaaaaaaauca

SEQ ID NO: 41022 - RNA, 20 nt, Artificial Sequence
  CIITA targeting sequence
cgcucugucacccagggugg

SEQ ID NO: 41023 - RNA, 20 nt, Artificial Sequence
  CIITA targeting sequence
cucugucacccaggguggag

SEQ ID NO: 41024 - RNA, 20 nt, Artificial Sequence
  CIITA targeting sequence
gucacccaggguggagugca

SEQ ID NO: 41025 - RNA, 20 nt, Artificial Sequence
  CIITA targeting sequence
cccaggguggagugcagugg

SEQ ID NO: 41026 - RNA, 20 nt, Artificial Sequence
  CIITA targeting sequence
acccugggugacagagcgag

SEQ ID NO: 41027 - RNA, 20 nt, Artificial Sequence
  CIITA targeting sequence
uggcucacugcagccucaau

SEQ ID NO: 41028 - RNA, 20 nt, Artificial Sequence
  CIITA targeting sequence
cugcagccucaaucuccuag

SEQ ID NO: 41029 - RNA, 20 nt, Artificial Sequence
  CIITA targeting sequence
aucuccuaggcucaagcaau

SEQ ID NO: 41030 - RNA, 20 nt, Artificial Sequence
  CIITA targeting sequence
ccuaggcucaagcaauccuc

SEQ ID NO: 41031 - RNA, 20 nt, Artificial Sequence
  CIITA targeting sequence
uaggcucaagcaauccuccc

SEQ ID NO: 41032 - RNA, 20 nt, Artificial Sequence
  CIITA targeting sequence
agcaauccucccaucucaac

SEQ ID NO: 41033 - RNA, 20 nt, Artificial Sequence
  CIITA targeting sequence
ucccaucucaaccuucugag

SEQ ID NO: 41034 - RNA, 20 nt, Artificial Sequence
  CIITA targeting sequence
caucucaaccuucugaguag

SEQ ID NO: 41035 - RNA, 20 nt, Artificial Sequence
  CIITA targeting sequence
caaccuucugaguagcuggg

SEQ ID NO: 41036 - RNA, 20 nt, Artificial Sequence
  CIITA targeting sequence
accuucugaguagcugggac

SEQ ID NO: 41037 - RNA, 20 nt, Artificial Sequence
  CIITA targeting sequence
gaguagcugggacaggugca

SEQ ID NO: 41038 - RNA, 20 nt, Artificial Sequence
  CIITA targeting sequence
gaagguugagaugggaggau

SEQ ID NO: 41039 - RNA, 20 nt, Artificial Sequence
  CIITA targeting sequence
cagcuacucagaagguugag

SEQ ID NO: 41040 - RNA, 20 nt, Artificial Sequence
  CIITA targeting sequence
cgcuaauuuuuguauuuuuu

SEQ ID NO: 41041 - RNA, 20 nt, Artificial Sequence
  CIITA targeting sequence
acaaaaaaauacaaaaauua

SEQ ID NO: 41042 - RNA, 20 nt, Artificial Sequence
  CIITA targeting sequence
cuacaaaaaaauacaaaaau

SEQ ID NO: 41043 - RNA, 20 nt, Artificial Sequence
  CIITA targeting sequence
ccacguugcccaggcugguc

SEQ ID NO: 41044 - RNA, 20 nt, Artificial Sequence
  CIITA targeting sequence
ugaacuucugagcucaagcc

SEQ ID NO: 41045 - RNA, 20 nt, Artificial Sequence
  CIITA targeting sequence
agaccagccugggcaacgug

SEQ ID NO: 41046 - RNA, 20 nt, Artificial Sequence
  CIITA targeting sequence
gagcucaagccauccuccug

SEQ ID NO: 41047 - RNA, 20 nt, Artificial Sequence
  CIITA targeting sequence
gaaguucaagaccagccugg

SEQ ID NO: 41048 - RNA, 20 nt, Artificial Sequence
  CIITA targeting sequence
agccauccuccugccucugc

SEQ ID NO: 41049 - RNA, 20 nt, Artificial Sequence
  CIITA targeting sequence
uccugccucugccucccaaa

SEQ ID NO: 41050 - RNA, 20 nt, Artificial Sequence
  CIITA targeting sequence
ugccucugccucccaaagua

SEQ ID NO: 41051 - RNA, 20 nt, Artificial Sequence
  CIITA targeting sequence
gccucccaaaguacugggau

SEQ ID NO: 41052 - RNA, 20 nt, Artificial Sequence
  CIITA targeting sequence
caaaguacugggauuacagg

SEQ ID NO: 41053 - RNA, 20 nt, Artificial Sequence
  CIITA targeting sequence
caguacuuugggaggcagag

SEQ ID NO: 41054 - RNA, 20 nt, Artificial Sequence
  CIITA targeting sequence
ugccuguaaucccaguacuu

SEQ ID NO: 41055 - RNA, 20 nt, Artificial Sequence
  CIITA targeting sequence
cugugccugguucaauggga

SEQ ID NO: 41056 - RNA, 20 nt, Artificial Sequence
  CIITA targeting sequence
augggauuuuuuuuuuuuuu

SEQ ID NO: 41057 - RNA, 20 nt, Artificial Sequence
  CIITA targeting sequence
cauugaaccaggcacaguga

SEQ ID NO: 41058 - RNA, 20 nt, Artificial Sequence
  CIITA targeting sequence
aaaaaaaaaaaaaaaaaucc

SEQ ID NO: 41059 - RNA, 20 nt, Artificial Sequence
  CIITA targeting sequence
gugucaaaaaaaaaaaaaaa

SEQ ID NO: 41060 - RNA, 20 nt, Artificial Sequence
  CIITA targeting sequence
cgcucuguagcccaggcugg

SEQ ID NO: 41061 - RNA, 20 nt, Artificial Sequence
  CIITA targeting sequence
cucuguagcccaggcuggag

SEQ ID NO: 41062 - RNA, 20 nt, Artificial Sequence
  CIITA targeting sequence
guagcccaggcuggagugca

SEQ ID NO: 41063 - RNA, 20 nt, Artificial Sequence
  CIITA targeting sequence
agccugggcuacagagcgag

SEQ ID NO: 41064 - RNA, 20 nt, Artificial Sequence
  CIITA targeting sequence
uaccacugcacuccagccug

SEQ ID NO: 41065 - RNA, 20 nt, Artificial Sequence
  CIITA targeting sequence
auuuauugcaaacuucaccu

SEQ ID NO: 41066 - RNA, 20 nt, Artificial Sequence
  CIITA targeting sequence
ccuccuggguucaagcaauu

SEQ ID NO: 41067 - RNA, 20 nt, Artificial Sequence
  CIITA targeting sequence
uggguucaagcaauucucac

SEQ ID NO: 41068 - RNA, 20 nt, Artificial Sequence
  CIITA targeting sequence
agcaauucucacaccucagc

SEQ ID NO: 41069 - RNA, 20 nt, Artificial Sequence
  CIITA targeting sequence
cacaccucagccucccaagu

SEQ ID NO: 41070 - RNA, 20 nt, Artificial Sequence
  CIITA targeting sequence
caccucagccucccaaguag

SEQ ID NO: 41071 - RNA, 20 nt, Artificial Sequence
  CIITA targeting sequence
gccucccaaguagcuggaau

SEQ ID NO: 41072 - RNA, 20 nt, Artificial Sequence
  CIITA targeting sequence
caaguagcuggaauuacagg

SEQ ID NO: 41073 - RNA, 20 nt, Artificial Sequence
  CIITA targeting sequence
agcuacuugggaggcugagg

SEQ ID NO: 41074 - RNA, 20 nt, Artificial Sequence
  CIITA targeting sequence
acuaaaaauacaaaaauuag

SEQ ID NO: 41075 - RNA, 20 nt, Artificial Sequence
  CIITA targeting sequence
cuacuaaaaauacaaaaauu

SEQ ID NO: 41076 - RNA, 20 nt, Artificial Sequence
  CIITA targeting sequence
ccagguuggccaggcugguc

SEQ ID NO: 41077 - RNA, 20 nt, Artificial Sequence
  CIITA targeting sequence
ugaacuccugaccucaagug

SEQ ID NO: 41078 - RNA, 20 nt, Artificial Sequence
  CIITA targeting sequence
agaccagccuggccaaccug

SEQ ID NO: 41079 - RNA, 20 nt, Artificial Sequence
  CIITA targeting sequence
ugaccucaagugauccgccc

SEQ ID NO: 41080 - RNA, 20 nt, Artificial Sequence
  CIITA targeting sequence
ggaguucaagaccagccugg

SEQ ID NO: 41081 - RNA, 20 nt, Artificial Sequence
  CIITA targeting sequence
agugauccgcccaccucagc

SEQ ID NO: 41082 - RNA, 20 nt, Artificial Sequence
  CIITA targeting sequence
cuugaggucaggaguucaag

SEQ ID NO: 41083 - RNA, 20 nt, Artificial Sequence
  CIITA targeting sequence
gcccaccucagccucccaaa

SEQ ID NO: 41084 - RNA, 20 nt, Artificial Sequence
  CIITA targeting sequence
gccucccaaagugcugggau

SEQ ID NO: 41085 - RNA, 20 nt, Artificial Sequence
  CIITA targeting sequence
caaagugcugggauuaccgg

SEQ ID NO: 41086 - RNA, 20 nt, Artificial Sequence
  CIITA targeting sequence
cagcacuuugggaggcugag

SEQ ID NO: 41087 - RNA, 20 nt, Artificial Sequence
  CIITA targeting sequence
ugccgguaaucccagcacuu

SEQ ID NO: 41088 - RNA, 20 nt, Artificial Sequence
  CIITA targeting sequence
acaugauuuuuuacugaacc

SEQ ID NO: 41089 - RNA, 20 nt, Artificial Sequence
  CIITA targeting sequence
uguugaacugggcguggugg

SEQ ID NO: 41090 - RNA, 20 nt, Artificial Sequence
  CIITA targeting sequence
guaaaaaaucauguugaacu

SEQ ID NO: 41091 - RNA, 20 nt, Artificial Sequence
  CIITA targeting sequence
agguucaguaaaaaaucaug

SEQ ID NO: 41092 - RNA, 20 nt, Artificial Sequence
  CIITA targeting sequence
ucuagguucaguaaaaaauc

SEQ ID NO: 41093 - RNA, 20 nt, Artificial Sequence
  CIITA targeting sequence
aaaucuucccacacuccccc

SEQ ID NO: 41094 - RNA, 20 nt, Artificial Sequence
  CIITA targeting sequence
ucccacacucccccucacaa

SEQ ID NO: 41095 - RNA, 20 nt, Artificial Sequence
  CIITA targeting sequence
cacacucccccucacaacca

SEQ ID NO: 41096 - RNA, 20 nt, Artificial Sequence
  CIITA targeting sequence
cccucacaaccaaggucuua

SEQ ID NO: 41097 - RNA, 20 nt, Artificial Sequence
  CIITA targeting sequence
caaccaaggucuuaggaugg

SEQ ID NO: 41098 - RNA, 20 nt, Artificial Sequence
  CIITA targeting sequence
uaggauggccaaauaauuua

SEQ ID NO: 41099 - RNA, 20 nt, Artificial Sequence
  CIITA targeting sequence
uaagaccuugguugugaggg

SEQ ID NO: 41100 - RNA, 20 nt, Artificial Sequence
  CIITA targeting sequence
gguaaauuauuuggccaucc

SEQ ID NO: 41101 - RNA, 20 nt, Artificial Sequence
  CIITA targeting sequence
uuaauuguaggacuguggga

SEQ ID NO: 41102 - RNA, 20 nt, Artificial Sequence
  CIITA targeting sequence
uacaauuaaggaaauugcua

SEQ ID NO: 41103 - RNA, 20 nt, Artificial Sequence
  CIITA targeting sequence
cacaguccuacaauuaagga

SEQ ID NO: 41104 - RNA, 20 nt, Artificial Sequence
  CIITA targeting sequence
ccaguaauuucuaguguccu

SEQ ID NO: 41105 - RNA, 20 nt, Artificial Sequence
  CIITA targeting sequence
aguaauuucuaguguccuag

SEQ ID NO: 41106 - RNA, 20 nt, Artificial Sequence
  CIITA targeting sequence
aguguccuagguaacacugu

SEQ ID NO: 41107 - RNA, 20 nt, Artificial Sequence
  CIITA targeting sequence
uagguaacacuguaagcuag

SEQ ID NO: 41108 - RNA, 20 nt, Artificial Sequence
  CIITA targeting sequence
agcuuacaguguuaccuagg

SEQ ID NO: 41109 - RNA, 20 nt, Artificial Sequence
  CIITA targeting sequence
ucuccuuaguccuuccgucc

SEQ ID NO: 41110 - RNA, 20 nt, Artificial Sequence
  CIITA targeting sequence
ccuuaguccuuccguccccc

SEQ ID NO: 41111 - RNA, 20 nt, Artificial Sequence
  CIITA targeting sequence
uuaguccuuccgucccccuc

SEQ ID NO: 41112 - RNA, 20 nt, Artificial Sequence
  CIITA targeting sequence
uuccgucccccucuuucuua

SEQ ID NO: 41113 - RNA, 20 nt, Artificial Sequence
  CIITA targeting sequence
gucccccucuuucuuacccg

SEQ ID NO: 41114 - RNA, 20 nt, Artificial Sequence
  CIITA targeting sequence
cccucuuucuuacccgccac

SEQ ID NO: 41115 - RNA, 20 nt, Artificial Sequence
  CIITA targeting sequence
uucuuacccgccaccccacu

SEQ ID NO: 41116 - RNA, 20 nt, Artificial Sequence
  CIITA targeting sequence
uacccgccaccccacuuaag

SEQ ID NO: 41117 - RNA, 20 nt, Artificial Sequence
  CIITA targeting sequence
auaaauacuuaaguggggug

SEQ ID NO: 41118 - RNA, 20 nt, Artificial Sequence
  CIITA targeting sequence
aggcacagggauacaguaau

SEQ ID NO: 41119 - RNA, 20 nt, Artificial Sequence
  CIITA targeting sequence
cugugccuagagcacugcca

SEQ ID NO: 41120 - RNA, 20 nt, Artificial Sequence
  CIITA targeting sequence
uuacuguaucccugugccua

SEQ ID NO: 41121 - RNA, 20 nt, Artificial Sequence
  CIITA targeting sequence
guuuugcucauuacuguauc

SEQ ID NO: 41122 - RNA, 20 nt, Artificial Sequence
  CIITA targeting sequence
augugaagcccacaacccgg

SEQ ID NO: 41123 - RNA, 20 nt, Artificial Sequence
  CIITA targeting sequence
cauggagcagggcugugucu

SEQ ID NO: 41124 - RNA, 20 nt, Artificial Sequence
  CIITA targeting sequence
gccggguugugggcuucaca

SEQ ID NO: 41125 - RNA, 20 nt, Artificial Sequence
  CIITA targeting sequence
uuucugccggguugugggcu

SEQ ID NO: 41126 - RNA, 20 nt, Artificial Sequence
  CIITA targeting sequence
uuauagugcugaaaaguggc

SEQ ID NO: 41127 - RNA, 20 nt, Artificial Sequence
  CIITA targeting sequence
gcacuauaaugaaauaagug

SEQ ID NO: 41128 - RNA, 20 nt, Artificial Sequence
  CIITA targeting sequence
gcgccacuuuucagcacuau

SEQ ID NO: 41129 - RNA, 20 nt, Artificial Sequence
  CIITA targeting sequence
cucugcgccacuuuucagca

SEQ ID NO: 41130 - RNA, 20 nt, Artificial Sequence
  CIITA targeting sequence
uuucccucugcgccacuuuu

SEQ ID NO: 41131 - RNA, 20 nt, Artificial Sequence
  CIITA targeting sequence
ccucuuuucccucugcgcca

SEQ ID NO: 41132 - RNA, 20 nt, Artificial Sequence
  CIITA targeting sequence
ugggacaggugggggcagga

SEQ ID NO: 41133 - RNA, 20 nt, Artificial Sequence
  CIITA targeting sequence
caugacuuuacaacaucccc

SEQ ID NO: 41134 - RNA, 20 nt, Artificial Sequence
  CIITA targeting sequence
ugcccccaccugucccauga

SEQ ID NO: 41135 - RNA, 20 nt, Artificial Sequence
  CIITA targeting sequence
cccucccauccaccuccuca

SEQ ID NO: 41136 - RNA, 20 nt, Artificial Sequence
  CIITA targeting sequence
cucccauccaccuccucauc

SEQ ID NO: 41137 - RNA, 20 nt, Artificial Sequence
  CIITA targeting sequence
cauccaccuccucaucccug

SEQ ID NO: 41138 - RNA, 20 nt, Artificial Sequence
  CIITA targeting sequence
accuccucaucccugcccuc

SEQ ID NO: 41139 - RNA, 20 nt, Artificial Sequence
  CIITA targeting sequence
ucaucccugcccucccacuu

SEQ ID NO: 41140 - RNA, 20 nt, Artificial Sequence
  CIITA targeting sequence
ucccugcccucccacuuggc

SEQ ID NO: 41141 - RNA, 20 nt, Artificial Sequence
  CIITA targeting sequence
cugcccucccacuuggccac

SEQ ID NO: 41142 - RNA, 20 nt, Artificial Sequence
  CIITA targeting sequence
cacuuggccacaggaccuaa

SEQ ID NO: 41143 - RNA, 20 nt, Artificial Sequence
  CIITA targeting sequence
uguggccaagugggagggca

SEQ ID NO: 41144 - RNA, 20 nt, Artificial Sequence
  CIITA targeting sequence
uccuauuuaccgagagguag

SEQ ID NO: 41145 - RNA, 20 nt, Artificial Sequence
  CIITA targeting sequence
uauuuaccgagagguagcuu

SEQ ID NO: 41146 - RNA, 20 nt, Artificial Sequence
  CIITA targeting sequence
guaaauaggaggauacuguu

SEQ ID NO: 41147 - RNA, 20 nt, Artificial Sequence
  CIITA targeting sequence
cgguaaauaggaggauacug

SEQ ID NO: 41148 - RNA, 20 nt, Artificial Sequence
  CIITA targeting sequence
gucgacagcgccauucacag

SEQ ID NO: 41149 - RNA, 20 nt, Artificial Sequence
  CIITA targeting sequence
acagcgccauucacagccua

SEQ ID NO: 41150 - RNA, 20 nt, Artificial Sequence
  CIITA targeting sequence
acagacuuaagcuaccucuc

SEQ ID NO: 41151 - RNA, 20 nt, Artificial Sequence
  CIITA targeting sequence
cagccuaugacccagaacuc

SEQ ID NO: 41152 - RNA, 20 nt, Artificial Sequence
  CIITA targeting sequence
uaggcugugaauggcgcugu

SEQ ID NO: 41153 - RNA, 20 nt, Artificial Sequence
  CIITA targeting sequence
gggucauaggcugugaaugg

SEQ ID NO: 41154 - RNA, 20 nt, Artificial Sequence
  CIITA targeting sequence
ccuugaggucaaagugaggc

SEQ ID NO: 41155 - RNA, 20 nt, Artificial Sequence
  CIITA targeting sequence
uugaggucaaagugaggcau

SEQ ID NO: 41156 - RNA, 20 nt, Artificial Sequence
  CIITA targeting sequence
aggagaguucugggucauag

SEQ ID NO: 41157 - RNA, 20 nt, Artificial Sequence
  CIITA targeting sequence
aagugaggcaugcaaguuug

SEQ ID NO: 41158 - RNA, 20 nt, Artificial Sequence
  CIITA targeting sequence
cuuugaccucaaggagaguu

SEQ ID NO: 41159 - RNA, 20 nt, Artificial Sequence
  CIITA targeting sequence
ugagcccucccccucacugu

SEQ ID NO: 41160 - RNA, 20 nt, Artificial Sequence
  CIITA targeting sequence
ggaccaaacuugcaugccuc

SEQ ID NO: 41161 - RNA, 20 nt, Artificial Sequence
  CIITA targeting sequence
cccucacuguguccccgcag

SEQ ID NO: 41162 - RNA, 20 nt, Artificial Sequence
  CIITA targeting sequence
cuguguccccgcagucuguc

SEQ ID NO: 41163 - RNA, 20 nt, Artificial Sequence
  CIITA targeting sequence
ccgcagucugucccagaaca

SEQ ID NO: 41164 - RNA, 20 nt, Artificial Sequence
  CIITA targeting sequence
gucccagaacaacaucacug

SEQ ID NO: 41165 - RNA, 20 nt, Artificial Sequence
  CIITA targeting sequence
cagaacaacaucacugaccu

SEQ ID NO: 41166 - RNA, 20 nt, Artificial Sequence
  CIITA targeting sequence
gggacagacugcggggacac

SEQ ID NO: 41167 - RNA, 20 nt, Artificial Sequence
  CIITA targeting sequence
cugaccugggugccuacaaa

SEQ ID NO: 41168 - RNA, 20 nt, Artificial Sequence
  CIITA targeting sequence
gugauguuguucugggacag

SEQ ID NO: 41169 - RNA, 20 nt, Artificial Sequence
  CIITA targeting sequence
ccgaggcccugccuucgcuc

SEQ ID NO: 41170 - RNA, 20 nt, Artificial Sequence
  CIITA targeting sequence
gcgaguuuguaggcacccag

SEQ ID NO: 41171 - RNA, 20 nt, Artificial Sequence
  CIITA targeting sequence
cucgcugcaucccugcucag

SEQ ID NO: 41172 - RNA, 20 nt, Artificial Sequence
  CIITA targeting sequence
cugcaucccugcucaggcua

SEQ ID NO: 41173 - RNA, 20 nt, Artificial Sequence
  CIITA targeting sequence
cugcucaggcuaaggugagu

SEQ ID NO: 41174 - RNA, 20 nt, Artificial Sequence
  CIITA targeting sequence
ggcuaaggugaguggggccc

SEQ ID NO: 41175 - RNA, 20 nt, Artificial Sequence
  CIITA targeting sequence
ccuuagccugagcagggaug

SEQ ID NO: 41176 - RNA, 20 nt, Artificial Sequence
  CIITA targeting sequence
ggggccccacucaccuuagc

SEQ ID NO: 41177 - RNA, 20 nt, Artificial Sequence
  CIITA targeting sequence
ggugcugagcuggggggcug

SEQ ID NO: 41178 - RNA, 20 nt, Artificial Sequence
  CIITA targeting sequence
gcaccugaccgguauccggg

SEQ ID NO: 41179 - RNA, 20 nt, Artificial Sequence
  CIITA targeting sequence
gcagccccccagcucagcac

SEQ ID NO: 41180 - RNA, 20 nt, Artificial Sequence
  CIITA targeting sequence
cugcgcucugcagcccccca

SEQ ID NO: 41181 - RNA, 20 nt, Artificial Sequence
  CIITA targeting sequence
ugcuggcugcaggggacacu

SEQ ID NO: 41182 - RNA, 20 nt, Artificial Sequence
  CIITA targeting sequence
ccugcagccagcacgaugug

SEQ ID NO: 41183 - RNA, 20 nt, Artificial Sequence
  CIITA targeting sequence
guguccccugcagccagcac

SEQ ID NO: 41184 - RNA, 20 nt, Artificial Sequence
  CIITA targeting sequence
caguguccccugcagccagc

SEQ ID NO: 41185 - RNA, 20 nt, Artificial Sequence
  CIITA targeting sequence
agggucucaguguccccugc

SEQ ID NO: 41186 - RNA, 20 nt, Artificial Sequence
  CIITA targeting sequence
ccacagcccugaacaaaagg

SEQ ID NO: 41187 - RNA, 20 nt, Artificial Sequence
  CIITA targeting sequence
gggcuguggugauugcuucu

SEQ ID NO: 41188 - RNA, 20 nt, Artificial Sequence
  CIITA targeting sequence
uuuuguucagggcuguggug

SEQ ID NO: 41189 - RNA, 20 nt, Artificial Sequence
  CIITA targeting sequence
cgcuaauccuuuuguucagg

SEQ ID NO: 41190 - RNA, 20 nt, Artificial Sequence
  CIITA targeting sequence
ccacgucccgcuaauccuuu

SEQ ID NO: 41191 - RNA, 20 nt, Artificial Sequence
  CIITA targeting sequence
uucaccacgucccgcuaauc

SEQ ID NO: 41192 - RNA, 20 nt, Artificial Sequence
  CIITA targeting sequence
gagcaagucaguuauucauu

SEQ ID NO: 41193 - RNA, 20 nt, Artificial Sequence
  CIITA targeting sequence
gaguuucuuucaccacgucc

SEQ ID NO: 41194 - RNA, 20 nt, Artificial Sequence
  CIITA targeting sequence
guuauucauuccuagccgcu

SEQ ID NO: 41195 - RNA, 20 nt, Artificial Sequence
  CIITA targeting sequence
uuccuagccgcuguuuucuu

SEQ ID NO: 41196 - RNA, 20 nt, Artificial Sequence
  CIITA targeting sequence
uagccgcuguuuucuuaccu

SEQ ID NO: 41197 - RNA, 20 nt, Artificial Sequence
  CIITA targeting sequence
uaccuggaaaaugggaacca

SEQ ID NO: 41198 - RNA, 20 nt, Artificial Sequence
  CIITA targeting sequence
agguaagaaaacagcggcua

SEQ ID NO: 41199 - RNA, 20 nt, Artificial Sequence
  CIITA targeting sequence
cauuuuccagguaagaaaac

SEQ ID NO: 41200 - RNA, 20 nt, Artificial Sequence
  CIITA targeting sequence
uaauggucuauguaagcacu

SEQ ID NO: 41201 - RNA, 20 nt, Artificial Sequence
  CIITA targeting sequence
auguaagcacuugucacaau

SEQ ID NO: 41202 - RNA, 20 nt, Artificial Sequence
  CIITA targeting sequence
caaugccagguucuguuaug

SEQ ID NO: 41203 - RNA, 20 nt, Artificial Sequence
  CIITA targeting sequence
guuaugcaauaaauauugcu

SEQ ID NO: 41204 - RNA, 20 nt, Artificial Sequence
  CIITA targeting sequence
uuuucccccagggauggcgg

SEQ ID NO: 41205 - RNA, 20 nt, Artificial Sequence
  CIITA targeting sequence
cccagggauggcgggaccag

SEQ ID NO: 41206 - RNA, 20 nt, Artificial Sequence
  CIITA targeting sequence
cugggggaaaaggagcaaua

SEQ ID NO: 41207 - RNA, 20 nt, Artificial Sequence
  CIITA targeting sequence
cgccaucccugggggaaaag

SEQ ID NO: 41208 - RNA, 20 nt, Artificial Sequence
  CIITA targeting sequence
ggaaccuaggggugguggcu

SEQ ID NO: 41209 - RNA, 20 nt, Artificial Sequence
  CIITA targeting sequence
ggaaaaagccuggucccgcc

SEQ ID NO: 41210 - RNA, 20 nt, Artificial Sequence
  CIITA targeting sequence
ggaaggcuaaccacguacgu

SEQ ID NO: 41211 - RNA, 20 nt, Artificial Sequence
  CIITA targeting sequence
agaagccaccaccccuaggu

SEQ ID NO: 41212 - RNA, 20 nt, Artificial Sequence
  CIITA targeting sequence
gcuuuugccggccuugucac

SEQ ID NO: 41213 - RNA, 20 nt, Artificial Sequence
  CIITA targeting sequence
cuuacaugccggucaguguu

SEQ ID NO: 41214 - RNA, 20 nt, Artificial Sequence
  CIITA targeting sequence
guguuucacugccaccuucu

SEQ ID NO: 41215 - RNA, 20 nt, Artificial Sequence
  CIITA targeting sequence
cugccaccuucugguaggcc

SEQ ID NO: 41216 - RNA, 20 nt, Artificial Sequence
  CIITA targeting sequence
gguaggccuuggcauagcac

SEQ ID NO: 41217 - RNA, 20 nt, Artificial Sequence
  CIITA targeting sequence
ugcuuuugagugacuuccau

SEQ ID NO: 41218 - RNA, 20 nt, Artificial Sequence
  CIITA targeting sequence
aaagcaagaggugcuaugcc

SEQ ID NO: 41219 - RNA, 20 nt, Artificial Sequence
  CIITA targeting sequence
cucaaaagcaagaggugcua

SEQ ID NO: 41220 - RNA, 20 nt, Artificial Sequence
  CIITA targeting sequence
auccaggcccuggugugguc

SEQ ID NO: 41221 - RNA, 20 nt, Artificial Sequence
  CIITA targeting sequence
aggcccugguguggucccag

SEQ ID NO: 41222 - RNA, 20 nt, Artificial Sequence
  CIITA targeting sequence
cagagguaaugagcggacug

SEQ ID NO: 41223 - RNA, 20 nt, Artificial Sequence
  CIITA targeting sequence
gggaccacaccagggccugg

SEQ ID NO: 41224 - RNA, 20 nt, Artificial Sequence
  CIITA targeting sequence
uuaccucugggaccacacca

SEQ ID NO: 41225 - RNA, 20 nt, Artificial Sequence
  CIITA targeting sequence
gcucauuaccucugggacca

SEQ ID NO: 41226 - RNA, 20 nt, Artificial Sequence
  CIITA targeting sequence
guccgcucauuaccucuggg

SEQ ID NO: 41227 - RNA, 20 nt, Artificial Sequence
  CIITA targeting sequence
aagcucaguccgcucauuac

SEQ ID NO: 41228 - RNA, 20 nt, Artificial Sequence
  CIITA targeting sequence
gguccaagcucaguccgcuc

SEQ ID NO: 41229 - RNA, 20 nt, Artificial Sequence
  CIITA targeting sequence
uccaacucagcauuaccagc

SEQ ID NO: 41230 - RNA, 20 nt, Artificial Sequence
  CIITA targeting sequence
aacucagcauuaccagcucu

SEQ ID NO: 41231 - RNA, 20 nt, Artificial Sequence
  CIITA targeting sequence
gcauuaccagcucuucuuac

SEQ ID NO: 41232 - RNA, 20 nt, Artificial Sequence
  CIITA targeting sequence
ucuuacucgccagacugaga

SEQ ID NO: 41233 - RNA, 20 nt, Artificial Sequence
  CIITA targeting sequence
uacucgccagacugagagaa

SEQ ID NO: 41234 - RNA, 20 nt, Artificial Sequence
  CIITA targeting sequence
ccagacugagagaaacugcu

SEQ ID NO: 41235 - RNA, 20 nt, Artificial Sequence
  CIITA targeting sequence
ggcgaguaagaagagcuggu

SEQ ID NO: 41236 - RNA, 20 nt, Artificial Sequence
  CIITA targeting sequence
gucuggcgaguaagaagagc

SEQ ID NO: 41237 - RNA, 20 nt, Artificial Sequence
  CIITA targeting sequence
cagucuggcgaguaagaaga

SEQ ID NO: 41238 - RNA, 20 nt, Artificial Sequence
  CIITA targeting sequence
cucagucuggcgaguaagaa

SEQ ID NO: 41239 - RNA, 20 nt, Artificial Sequence
  CIITA targeting sequence
ccucuucgccagagcucuuc

SEQ ID NO: 41240 - RNA, 20 nt, Artificial Sequence
  CIITA targeting sequence
ucuucgccagagcucuucac

SEQ ID NO: 41241 - RNA, 20 nt, Artificial Sequence
  CIITA targeting sequence
ucgccagagcucuucacuua

SEQ ID NO: 41242 - RNA, 20 nt, Artificial Sequence
  CIITA targeting sequence
ccagagcucuucacuuacug

SEQ ID NO: 41243 - RNA, 20 nt, Artificial Sequence
  CIITA targeting sequence
ggcgaagaggagagcaguuu

SEQ ID NO: 41244 - RNA, 20 nt, Artificial Sequence
  CIITA targeting sequence
ucacuuacugaggacaacca

SEQ ID NO: 41245 - RNA, 20 nt, Artificial Sequence
  CIITA targeting sequence
cuuacugaggacaaccagag

SEQ ID NO: 41246 - RNA, 20 nt, Artificial Sequence
  CIITA targeting sequence
guaagugaagagcucuggcg

SEQ ID NO: 41247 - RNA, 20 nt, Artificial Sequence
  CIITA targeting sequence
ucaguaagugaagagcucug

SEQ ID NO: 41248 - RNA, 20 nt, Artificial Sequence
  CIITA targeting sequence
gguuguccucaguaagugaa

SEQ ID NO: 41249 - RNA, 20 nt, Artificial Sequence
  CIITA targeting sequence
gauucccaggaaagauggca

SEQ ID NO: 41250 - RNA, 20 nt, Artificial Sequence
  CIITA targeting sequence
gacucugguuguccucagua

SEQ ID NO: 41251 - RNA, 20 nt, Artificial Sequence
  CIITA targeting sequence
caggaaagauggcauuuggu

SEQ ID NO: 41252 - RNA, 20 nt, Artificial Sequence
  CIITA targeting sequence
ugggaaucugacucugguug

SEQ ID NO: 41253 - RNA, 20 nt, Artificial Sequence
  CIITA targeting sequence
uuccugggaaucugacucug

SEQ ID NO: 41254 - RNA, 20 nt, Artificial Sequence
  CIITA targeting sequence
cuuauuauuuauuuauuuuu

SEQ ID NO: 41255 - RNA, 20 nt, Artificial Sequence
  CIITA targeting sequence
guuuuugagauggagucucg

SEQ ID NO: 41256 - RNA, 20 nt, Artificial Sequence
  CIITA targeting sequence
aaaacagaaauuaaaaaaau

SEQ ID NO: 41257 - RNA, 20 nt, Artificial Sequence
  CIITA targeting sequence
caaaaacagaaauuaaaaaa

SEQ ID NO: 41258 - RNA, 20 nt, Artificial Sequence
  CIITA targeting sequence
aucucaaaaacagaaauuaa

SEQ ID NO: 41259 - RNA, 20 nt, Artificial Sequence
  CIITA targeting sequence
cgcucugucacccaggcugg

SEQ ID NO: 41260 - RNA, 20 nt, Artificial Sequence
  CIITA targeting sequence
cucugucacccaggcuggag

SEQ ID NO: 41261 - RNA, 20 nt, Artificial Sequence
  CIITA targeting sequence
gucacccaggcuggagugaa

SEQ ID NO: 41262 - RNA, 20 nt, Artificial Sequence
  CIITA targeting sequence
cccaggcuggagugaagugg

SEQ ID NO: 41263 - RNA, 20 nt, Artificial Sequence
  CIITA targeting sequence
agccugggugacagagcgag

SEQ ID NO: 41264 - RNA, 20 nt, Artificial Sequence
  CIITA targeting sequence
cuccagccugggugacagag

SEQ ID NO: 41265 - RNA, 20 nt, Artificial Sequence
  CIITA targeting sequence
caccacuucacuccagccug

SEQ ID NO: 41266 - RNA, 20 nt, Artificial Sequence
  CIITA targeting sequence
cagcucacugcaacuucugc

SEQ ID NO: 41267 - RNA, 20 nt, Artificial Sequence
  CIITA targeting sequence
gcucacugcaacuucugccc

SEQ ID NO: 41268 - RNA, 20 nt, Artificial Sequence
  CIITA targeting sequence
cugcaacuucugcccccccc

SEQ ID NO: 41269 - RNA, 20 nt, Artificial Sequence
  CIITA targeting sequence
gcccccccccagguucaagc

SEQ ID NO: 41270 - RNA, 20 nt, Artificial Sequence
  CIITA targeting sequence
agcuauucgccugccucagu

SEQ ID NO: 41271 - RNA, 20 nt, Artificial Sequence
  CIITA targeting sequence
ccugccucagugcuccgagu

SEQ ID NO: 41272 - RNA, 20 nt, Artificial Sequence
  CIITA targeting sequence
gugcuccgaguagcugggau

SEQ ID NO: 41273 - RNA, 20 nt, Artificial Sequence
  CIITA targeting sequence
gaguagcugggauuauaggc

SEQ ID NO: 41274 - RNA, 20 nt, Artificial Sequence
  CIITA targeting sequence
gagcacugaggcaggcgaau

SEQ ID NO: 41275 - RNA, 20 nt, Artificial Sequence
  CIITA targeting sequence
cagcuacucggagcacugag

SEQ ID NO: 41276 - RNA, 20 nt, Artificial Sequence
  CIITA targeting sequence
agcuaguuuuuauauuuuua

SEQ ID NO: 41277 - RNA, 20 nt, Artificial Sequence
  CIITA targeting sequence
acuaaaaauauaaaaacuag

SEQ ID NO: 41278 - RNA, 20 nt, Artificial Sequence
  CIITA targeting sequence
cuacuaaaaauauaaaaacu

SEQ ID NO: 41279 - RNA, 20 nt, Artificial Sequence
  CIITA targeting sequence
ccauguuggccaggcugguc

SEQ ID NO: 41280 - RNA, 20 nt, Artificial Sequence
  CIITA targeting sequence
caaacuccugaucucaggug

SEQ ID NO: 41281 - RNA, 20 nt, Artificial Sequence
  CIITA targeting sequence
aacuccugaucucaggugau

SEQ ID NO: 41282 - RNA, 20 nt, Artificial Sequence
  CIITA targeting sequence
ugaucucaggugauccaccu

SEQ ID NO: 41283 - RNA, 20 nt, Artificial Sequence
  CIITA targeting sequence
ggaguuugagaccagccugg

SEQ ID NO: 41284 - RNA, 20 nt, Artificial Sequence
  CIITA targeting sequence
caggugauccaccugccucg

SEQ ID NO: 41285 - RNA, 20 nt, Artificial Sequence
  CIITA targeting sequence
ggugauccaccugccucggc

SEQ ID NO: 41286 - RNA, 20 nt, Artificial Sequence
  CIITA targeting sequence
ccugagaucaggaguuugag

SEQ ID NO: 41287 - RNA, 20 nt, Artificial Sequence
  CIITA targeting sequence
accugccucggccucccaaa

SEQ ID NO: 41288 - RNA, 20 nt, Artificial Sequence
  CIITA targeting sequence
gccucccaaagugaguacua

SEQ ID NO: 41289 - RNA, 20 nt, Artificial Sequence
  CIITA targeting sequence
caaagugaguacuaggauua

SEQ ID NO: 41290 - RNA, 20 nt, Artificial Sequence
  CIITA targeting sequence
cuuugggaggccgaggcagg

SEQ ID NO: 41291 - RNA, 20 nt, Artificial Sequence
  CIITA targeting sequence
uaguacucacuuugggaggc

SEQ ID NO: 41292 - RNA, 20 nt, Artificial Sequence
  CIITA targeting sequence
cgccuguaauccuaguacuc

SEQ ID NO: 41293 - RNA, 20 nt, Artificial Sequence
  CIITA targeting sequence
aaauaaauaaauaaauaaau

SEQ ID NO: 41294 - RNA, 20 nt, Artificial Sequence
  CIITA targeting sequence
ccaaauaaauaaauaaauaa

SEQ ID NO: 41295 - RNA, 20 nt, Artificial Sequence
  CIITA targeting sequence
cacccagguuguagugcagg

SEQ ID NO: 41296 - RNA, 20 nt, Artificial Sequence
  CIITA targeting sequence
cccagguuguagugcagggg

SEQ ID NO: 41297 - RNA, 20 nt, Artificial Sequence
  CIITA targeting sequence
uugcaccccugcacuacaac

SEQ ID NO: 41298 - RNA, 20 nt, Artificial Sequence
  CIITA targeting sequence
cuacagccucgacuaccugg

SEQ ID NO: 41299 - RNA, 20 nt, Artificial Sequence
  CIITA targeting sequence
acuaccuggacugaagcgaa

SEQ ID NO: 41300 - RNA, 20 nt, Artificial Sequence
  CIITA targeting sequence
aggcuguagugagccaucau

SEQ ID NO: 41301 - RNA, 20 nt, Artificial Sequence
  CIITA targeting sequence
agguagucgaggcuguagug

SEQ ID NO: 41302 - RNA, 20 nt, Artificial Sequence
  CIITA targeting sequence
guccagguagucgaggcugu

SEQ ID NO: 41303 - RNA, 20 nt, Artificial Sequence
  CIITA targeting sequence
cuucaguccagguagucgag

SEQ ID NO: 41304 - RNA, 20 nt, Artificial Sequence
  CIITA targeting sequence
caccucagccuuccaaguag

SEQ ID NO: 41305 - RNA, 20 nt, Artificial Sequence
  CIITA targeting sequence
gccuuccaaguagcuggguc

SEQ ID NO: 41306 - RNA, 20 nt, Artificial Sequence
  CIITA targeting sequence
aaguagcuggguccuauacc

SEQ ID NO: 41307 - RNA, 20 nt, Artificial Sequence
  CIITA targeting sequence
uauacccuccugagccuugu

SEQ ID NO: 41308 - RNA, 20 nt, Artificial Sequence
  CIITA targeting sequence
ugagccuuguuaauuucuuc

SEQ ID NO: 41309 - RNA, 20 nt, Artificial Sequence
  CIITA targeting sequence
ggaggguauaggacccagcu

SEQ ID NO: 41310 - RNA, 20 nt, Artificial Sequence
  CIITA targeting sequence
ucccagcaugaucacuguuu

SEQ ID NO: 41311 - RNA, 20 nt, Artificial Sequence
  CIITA targeting sequence
cagcaugaucacuguuuuac

SEQ ID NO: 41312 - RNA, 20 nt, Artificial Sequence
  CIITA targeting sequence
ugcugggaagaaauuaacaa

SEQ ID NO: 41313 - RNA, 20 nt, Artificial Sequence
  CIITA targeting sequence
cuguuuuacaauauuuuauu

SEQ ID NO: 41314 - RNA, 20 nt, Artificial Sequence
  CIITA targeting sequence
ugcuaugcaaagaaacucag

SEQ ID NO: 41315 - RNA, 20 nt, Artificial Sequence
  CIITA targeting sequence
uugcauagcaagaaguaagc

SEQ ID NO: 41316 - RNA, 20 nt, Artificial Sequence
  CIITA targeting sequence
gaagcaaaaauagaaucugu

SEQ ID NO: 41317 - RNA, 20 nt, Artificial Sequence
  CIITA targeting sequence
gaguuucuuugcauagcaag

SEQ ID NO: 41318 - RNA, 20 nt, Artificial Sequence
  CIITA targeting sequence
auuuuugcuucugaguuucu

SEQ ID NO: 41319 - RNA, 20 nt, Artificial Sequence
  CIITA targeting sequence
gucugguucauaauugugcu

SEQ ID NO: 41320 - RNA, 20 nt, Artificial Sequence
  CIITA targeting sequence
gguucauaauugugcuaaaa

SEQ ID NO: 41321 - RNA, 20 nt, Artificial Sequence
  CIITA targeting sequence
uaauugugcuaaaaacuaga

SEQ ID NO: 41322 - RNA, 20 nt, Artificial Sequence
  CIITA targeting sequence
aguuuuuagcacaauuauga

SEQ ID NO: 41323 - RNA, 20 nt, Artificial Sequence
  CIITA targeting sequence
cuaguuuuuagcacaauuau

SEQ ID NO: 41324 - RNA, 20 nt, Artificial Sequence
  CIITA targeting sequence
uacuuguaucucuaguuuuu

SEQ ID NO: 41325 - RNA, 20 nt, Artificial Sequence
  CIITA targeting sequence
aguucauacuuguaucucua

SEQ ID NO: 41326 - RNA, 20 nt, Artificial Sequence
  CIITA targeting sequence
gucuaguucauacuuguauc

SEQ ID NO: 41327 - RNA, 20 nt, Artificial Sequence
  CIITA targeting sequence
uucuugcuuuugaguuucuu

SEQ ID NO: 41328 - RNA, 20 nt, Artificial Sequence
  CIITA targeting sequence
ugcuuuugaguuucuuugcg

SEQ ID NO: 41329 - RNA, 20 nt, Artificial Sequence
  CIITA targeting sequence
aaagcaagaacgacaucugu

SEQ ID NO: 41330 - RNA, 20 nt, Artificial Sequence
  CIITA targeting sequence
uugcguaguaggaauuaggc

SEQ ID NO: 41331 - RNA, 20 nt, Artificial Sequence
  CIITA targeting sequence
uacuacgcaaagaaacucaa

SEQ ID NO: 41332 - RNA, 20 nt, Artificial Sequence
  CIITA targeting sequence
cuguuuuacaauauuuuauu

SEQ ID NO: 41333 - RNA, 20 nt, Artificial Sequence
  CIITA targeting sequence
ugcugggaaggaaacuaaca

SEQ ID NO: 41334 - RNA, 20 nt, Artificial Sequence
  CIITA targeting sequence
cagcaugaaucacuguuuua

SEQ ID NO: 41335 - RNA, 20 nt, Artificial Sequence
  CIITA targeting sequence
uucccagcaugaaucacugu

SEQ ID NO: 41336 - RNA, 20 nt, Artificial Sequence
  CIITA targeting sequence
uggggcuuguuaguuuccuu

SEQ ID NO: 41337 - RNA, 20 nt, Artificial Sequence
  CIITA targeting sequence
uguacccuccuggggcuugu

SEQ ID NO: 41338 - RNA, 20 nt, Artificial Sequence
  CIITA targeting sequence
ggggagaugauucuuccgug

SEQ ID NO: 41339 - RNA, 20 nt, Artificial Sequence
  CIITA targeting sequence
ccagaaguccuguacccucc

SEQ ID NO: 41340 - RNA, 20 nt, Artificial Sequence
  CIITA targeting sequence
ccccagaaguccuguacccu

SEQ ID NO: 41341 - RNA, 20 nt, Artificial Sequence
  CIITA targeting sequence
ucuccccagaaguccuguac

SEQ ID NO: 41342 - RNA, 20 nt, Artificial Sequence
  CIITA targeting sequence
uccgugggaagcucuagggg

SEQ ID NO: 41343 - RNA, 20 nt, Artificial Sequence
  CIITA targeting sequence
gugggaagcucuaggggaaa

SEQ ID NO: 41344 - RNA, 20 nt, Artificial Sequence
  CIITA targeting sequence
cacggaagaaucaucucccc

SEQ ID NO: 41345 - RNA, 20 nt, Artificial Sequence
  CIITA targeting sequence
aggggaaaaggacucuagga

SEQ ID NO: 41346 - RNA, 20 nt, Artificial Sequence
  CIITA targeting sequence
ccuagagcuucccacggaag

SEQ ID NO: 41347 - RNA, 20 nt, Artificial Sequence
  CIITA targeting sequence
uuuuccccuagagcuuccca

SEQ ID NO: 41348 - RNA, 20 nt, Artificial Sequence
  CIITA targeting sequence
aggaagaaagaacagcaggu

SEQ ID NO: 41349 - RNA, 20 nt, Artificial Sequence
  CIITA targeting sequence
uagaguccuuuuccccuaga

SEQ ID NO: 41350 - RNA, 20 nt, Artificial Sequence
  CIITA targeting sequence
uccuagaguccuuuuccccu

SEQ ID NO: 41351 - RNA, 20 nt, Artificial Sequence
  CIITA targeting sequence
uucuuccuagaguccuuuuc

SEQ ID NO: 41352 - RNA, 20 nt, Artificial Sequence
  CIITA targeting sequence
cacuuagggccuuugcaccu

SEQ ID NO: 41353 - RNA, 20 nt, Artificial Sequence
  CIITA targeting sequence
gaagggccacuguggcugug

SEQ ID NO: 41354 - RNA, 20 nt, Artificial Sequence
  CIITA targeting sequence
gacccuuaaaacacagcccc

SEQ ID NO: 41355 - RNA, 20 nt, Artificial Sequence
  CIITA targeting sequence
cuacacacagccacaguggc

SEQ ID NO: 41356 - RNA, 20 nt, Artificial Sequence
  CIITA targeting sequence
uucacuacacacagccacag

SEQ ID NO: 41357 - RNA, 20 nt, Artificial Sequence
  CIITA targeting sequence
cucauucacuacacacagcc

SEQ ID NO: 41358 - RNA, 20 nt, Artificial Sequence
  CIITA targeting sequence
gucccucauucacuacacac

SEQ ID NO: 41359 - RNA, 20 nt, Artificial Sequence
  CIITA targeting sequence
accauugcccagccucuguc

SEQ ID NO: 41360 - RNA, 20 nt, Artificial Sequence
  CIITA targeting sequence
ccuacuuccaccauugccca

SEQ ID NO: 41361 - RNA, 20 nt, Artificial Sequence
  CIITA targeting sequence
ggggaauccagaucacacag

SEQ ID NO: 41362 - RNA, 20 nt, Artificial Sequence
  CIITA targeting sequence
ccugaccuccccuacuucca

SEQ ID NO: 41363 - RNA, 20 nt, Artificial Sequence
  CIITA targeting sequence
agaucacacagggaggcccu

SEQ ID NO: 41364 - RNA, 20 nt, Artificial Sequence
  CIITA targeting sequence
ggauuccccugaccuccccu

SEQ ID NO: 41365 - RNA, 20 nt, Artificial Sequence
  CIITA targeting sequence
cacagggaggcccuuguggg

SEQ ID NO: 41366 - RNA, 20 nt, Artificial Sequence
  CIITA targeting sequence
cugugugaucuggauucccc

SEQ ID NO: 41367 - RNA, 20 nt, Artificial Sequence
  CIITA targeting sequence
caagagguauuugcaguuuu

SEQ ID NO: 41368 - RNA, 20 nt, Artificial Sequence
  CIITA targeting sequence
ugugacccacaagggccucc

SEQ ID NO: 41369 - RNA, 20 nt, Artificial Sequence
  CIITA targeting sequence
gugugaauggaaaaguaggu

SEQ ID NO: 41370 - RNA, 20 nt, Artificial Sequence
  CIITA targeting sequence
cacugaaaaacugcaaauac

SEQ ID NO: 41371 - RNA, 20 nt, Artificial Sequence
  CIITA targeting sequence
auucacacugaaaaacugca

SEQ ID NO: 41372 - RNA, 20 nt, Artificial Sequence
  CIITA targeting sequence
caggcccaccuacuuuucca

SEQ ID NO: 41373 - RNA, 20 nt, Artificial Sequence
  CIITA targeting sequence
ccuucccaggcccaccuacu

SEQ ID NO: 41374 - RNA, 20 nt, Artificial Sequence
  CIITA targeting sequence
agugucgccuucccaggccc

SEQ ID NO: 41375 - RNA, 20 nt, Artificial Sequence
  CIITA targeting sequence
gauuuacacuuuucuuuuuu

SEQ ID NO: 41376 - RNA, 20 nt, Artificial Sequence
  CIITA targeting sequence
gaucaagugucgccuuccca

SEQ ID NO: 41377 - RNA, 20 nt, Artificial Sequence
  CIITA targeting sequence
uuuuucuuuucuuuucuuuu

SEQ ID NO: 41378 - RNA, 20 nt, Artificial Sequence
  CIITA targeting sequence
uuucuuuucuuuuugagacc

SEQ ID NO: 41379 - RNA, 20 nt, Artificial Sequence
  CIITA targeting sequence
uuucuuuuugagaccaaguc

SEQ ID NO: 41380 - RNA, 20 nt, Artificial Sequence
  CIITA targeting sequence
uuuugagaccaagucucacu

SEQ ID NO: 41381 - RNA, 20 nt, Artificial Sequence
  CIITA targeting sequence
aaaagaaaagaaaagaaaaa

SEQ ID NO: 41382 - RNA, 20 nt, Artificial Sequence
  CIITA targeting sequence
caaaaagaaaagaaaagaaa

SEQ ID NO: 41383 - RNA, 20 nt, Artificial Sequence
  CIITA targeting sequence
cacuuuauugcccaggcuaa

SEQ ID NO: 41384 - RNA, 20 nt, Artificial Sequence
  CIITA targeting sequence
cuuuauugcccaggcuaagg

SEQ ID NO: 41385 - RNA, 20 nt, Artificial Sequence
  CIITA targeting sequence
ugccacugcaccuuagccug

SEQ ID NO: 41386 - RNA, 20 nt, Artificial Sequence
  CIITA targeting sequence
cagcucacugcaagcacugc

SEQ ID NO: 41387 - RNA, 20 nt, Artificial Sequence
  CIITA targeting sequence
gcucacugcaagcacugccu

SEQ ID NO: 41388 - RNA, 20 nt, Artificial Sequence
  CIITA targeting sequence
cugcaagcacugccuccugg

SEQ ID NO: 41389 - RNA, 20 nt, Artificial Sequence
  CIITA targeting sequence
uggguucaagugauucucau

SEQ ID NO: 41390 - RNA, 20 nt, Artificial Sequence
  CIITA targeting sequence
agugauucucaugccucagc

SEQ ID NO: 41391 - RNA, 20 nt, Artificial Sequence
  CIITA targeting sequence
cuugaacccaggaggcagug

SEQ ID NO: 41392 - RNA, 20 nt, Artificial Sequence
  CIITA targeting sequence
caugccucagccucccaagu

SEQ ID NO: 41393 - RNA, 20 nt, Artificial Sequence
  CIITA targeting sequence
ugccucagccucccaaguag

SEQ ID NO: 41394 - RNA, 20 nt, Artificial Sequence
  CIITA targeting sequence
gccucccaaguagcugggau

SEQ ID NO: 41395 - RNA, 20 nt, Artificial Sequence
  CIITA targeting sequence
caaguagcugggauuacaga

SEQ ID NO: 41396 - RNA, 20 nt, Artificial Sequence
  CIITA targeting sequence
cagcuacuugggaggcugag

SEQ ID NO: 41397 - RNA, 20 nt, Artificial Sequence
  CIITA targeting sequence
guaaucccagcuacuuggga

SEQ ID NO: 41398 - RNA, 20 nt, Artificial Sequence
  CIITA targeting sequence
guagagacagggcuucgcca

SEQ ID NO: 41399 - RNA, 20 nt, Artificial Sequence
  CIITA targeting sequence
acugaaaacacaaaaauagc

SEQ ID NO: 41400 - RNA, 20 nt, Artificial Sequence
  CIITA targeting sequence
cuacugaaaacacaaaaaua

SEQ ID NO: 41401 - RNA, 20 nt, Artificial Sequence
  CIITA targeting sequence
ccauguggcccagacugguc

SEQ ID NO: 41402 - RNA, 20 nt, Artificial Sequence
  CIITA targeting sequence
gggccacauggcgaagcccu

SEQ ID NO: 41403 - RNA, 20 nt, Artificial Sequence
  CIITA targeting sequence
ugaaauccugggcccaagcg

SEQ ID NO: 41404 - RNA, 20 nt, Artificial Sequence
  CIITA targeting sequence
agaccagucugggccacaug

SEQ ID NO: 41405 - RNA, 20 nt, Artificial Sequence
  CIITA targeting sequence
ugggcccaagcgauccaccc

SEQ ID NO: 41406 - RNA, 20 nt, Artificial Sequence
  CIITA targeting sequence
cuugggcccaggauuucaag

SEQ ID NO: 41407 - RNA, 20 nt, Artificial Sequence
  CIITA targeting sequence
acccaccucagccuuccaaa

SEQ ID NO: 41408 - RNA, 20 nt, Artificial Sequence
  CIITA targeting sequence
gccuuccaaagugcugggau

SEQ ID NO: 41409 - RNA, 20 nt, Artificial Sequence
  CIITA targeting sequence
aaagugcugggauuacgggu

SEQ ID NO: 41410 - RNA, 20 nt, Artificial Sequence
  CIITA targeting sequence
cagcacuuuggaaggcugag

SEQ ID NO: 41411 - RNA, 20 nt, Artificial Sequence
  CIITA targeting sequence
cacccguaaucccagcacuu

SEQ ID NO: 41412 - RNA, 20 nt, Artificial Sequence
  CIITA targeting sequence
ggcugggcaugguggcucac

SEQ ID NO: 41413 - RNA, 20 nt, Artificial Sequence
  CIITA targeting sequence
uaaaggguaaaucaggcugg

SEQ ID NO: 41414 - RNA, 20 nt, Artificial Sequence
  CIITA targeting sequence
uauuucauggaaucuaagau

SEQ ID NO: 41415 - RNA, 20 nt, Artificial Sequence
  CIITA targeting sequence
uggaaucuaagaugccaucc

SEQ ID NO: 41416 - RNA, 20 nt, Artificial Sequence
  CIITA targeting sequence
augaaauaugauguuucuua

SEQ ID NO: 41417 - RNA, 20 nt, Artificial Sequence
  CIITA targeting sequence
aagaugccauccauuguaag

SEQ ID NO: 41418 - RNA, 20 nt, Artificial Sequence
  CIITA targeting sequence
uagauuccaugaaauaugau

SEQ ID NO: 41419 - RNA, 20 nt, Artificial Sequence
  CIITA targeting sequence
auuguaagaccccaauauga

SEQ ID NO: 41420 - RNA, 20 nt, Artificial Sequence
  CIITA targeting sequence
uacaauggauggcaucuuag

SEQ ID NO: 41421 - RNA, 20 nt, Artificial Sequence
  CIITA targeting sequence
uauuggggucuuacaaugga

SEQ ID NO: 41422 - RNA, 20 nt, Artificial Sequence
  CIITA targeting sequence
caguuugcauuuuggccuca

SEQ ID NO: 41423 - RNA, 20 nt, Artificial Sequence
  CIITA targeting sequence
uauaaccaauagcgugucac

SEQ ID NO: 41424 - RNA, 20 nt, Artificial Sequence
  CIITA targeting sequence
ugaucucaaugauauucaaa

SEQ ID NO: 41425 - RNA, 20 nt, Artificial Sequence
  CIITA targeting sequence
ggaugugucuuauaaccaau

SEQ ID NO: 41426 - RNA, 20 nt, Artificial Sequence
  CIITA targeting sequence
caaugauauucaaaugguga

SEQ ID NO: 41427 - RNA, 20 nt, Artificial Sequence
  CIITA targeting sequence
augauauucaaauggugaca

SEQ ID NO: 41428 - RNA, 20 nt, Artificial Sequence
  CIITA targeting sequence
uugagaucaggaugugucuu

SEQ ID NO: 41429 - RNA, 20 nt, Artificial Sequence
  CIITA targeting sequence
aauggugacauauaugucuu

SEQ ID NO: 41430 - RNA, 20 nt, Artificial Sequence
  CIITA targeting sequence
ccauuugaauaucauugaga

SEQ ID NO: 41431 - RNA, 20 nt, Artificial Sequence
  CIITA targeting sequence
uggcaucgaugaaauauggu

SEQ ID NO: 41432 - RNA, 20 nt, Artificial Sequence
  CIITA targeting sequence
augaaauauggucagauuac

SEQ ID NO: 41433 - RNA, 20 nt, Artificial Sequence
  CIITA targeting sequence
augccaagacauauauguca

SEQ ID NO: 41434 - RNA, 20 nt, Artificial Sequence
  CIITA targeting sequence
ucgaugccaagacauauaug

SEQ ID NO: 41435 - RNA, 20 nt, Artificial Sequence
  CIITA targeting sequence
gauuacucucccuguggggu

SEQ ID NO: 41436 - RNA, 20 nt, Artificial Sequence
  CIITA targeting sequence
gaccauauuucaucgaugcc

SEQ ID NO: 41437 - RNA, 20 nt, Artificial Sequence
  CIITA targeting sequence
cccugugggguggaggaagg

SEQ ID NO: 41438 - RNA, 20 nt, Artificial Sequence
  CIITA targeting sequence
cugugggguggaggaagggu

SEQ ID NO: 41439 - RNA, 20 nt, Artificial Sequence
  CIITA targeting sequence
accccacagggagaguaauc

SEQ ID NO: 41440 - RNA, 20 nt, Artificial Sequence
  CIITA targeting sequence
uccaccccacagggagagua

SEQ ID NO: 41441 - RNA, 20 nt, Artificial Sequence
  CIITA targeting sequence
ccaggguucagagauugcaa

SEQ ID NO: 41442 - RNA, 20 nt, Artificial Sequence
  CIITA targeting sequence
aggguucagagauugcaaaa

SEQ ID NO: 41443 - RNA, 20 nt, Artificial Sequence
  CIITA targeting sequence
gagauugcaaaacccccauc

SEQ ID NO: 41444 - RNA, 20 nt, Artificial Sequence
  CIITA targeting sequence
gaacccuggagacccuuccu

SEQ ID NO: 41445 - RNA, 20 nt, Artificial Sequence
  CIITA targeting sequence
cugaacccuggagacccuuc

SEQ ID NO: 41446 - RNA, 20 nt, Artificial Sequence
  CIITA targeting sequence
aguuucugcacugguaccgg

SEQ ID NO: 41447 - RNA, 20 nt, Artificial Sequence
  CIITA targeting sequence
gcacugguaccggccgaccc

SEQ ID NO: 41448 - RNA, 20 nt, Artificial Sequence
  CIITA targeting sequence
gccgguaccagugcagaaac

SEQ ID NO: 41449 - RNA, 20 nt, Artificial Sequence
  CIITA targeting sequence
cgggucggccgguaccagug

SEQ ID NO: 41450 - RNA, 20 nt, Artificial Sequence
  CIITA targeting sequence
caucacgggucggccgguac

SEQ ID NO: 41451 - RNA, 20 nt, Artificial Sequence
  CIITA targeting sequence
acucacaucacgggucggcc

SEQ ID NO: 41452 - RNA, 20 nt, Artificial Sequence
  CIITA targeting sequence
ggcuaaaucaacucacauca

SEQ ID NO: 41453 - RNA, 20 nt, Artificial Sequence
  CIITA targeting sequence
acuuggcagcaguguaaacc

SEQ ID NO: 41454 - RNA, 20 nt, Artificial Sequence
  CIITA targeting sequence
uuuuuuuucgagacagaguu

SEQ ID NO: 41455 - RNA, 20 nt, Artificial Sequence
  CIITA targeting sequence
agacagaguuucgcucuugu

SEQ ID NO: 41456 - RNA, 20 nt, Artificial Sequence
  CIITA targeting sequence
aaaaaaaaagaaaaaaauaa

SEQ ID NO: 41457 - RNA, 20 nt, Artificial Sequence
  CIITA targeting sequence
cgaaaaaaaaagaaaaaaau

SEQ ID NO: 41458 - RNA, 20 nt, Artificial Sequence
  CIITA targeting sequence
gucucgaaaaaaaaagaaaa

SEQ ID NO: 41459 - RNA, 20 nt, Artificial Sequence
  CIITA targeting sequence
cucuuguugccaaggcugga

SEQ ID NO: 41460 - RNA, 20 nt, Artificial Sequence
  CIITA targeting sequence
uguugccaaggcuggagugc

SEQ ID NO: 41461 - RNA, 20 nt, Artificial Sequence
  CIITA targeting sequence
agccuuggcaacaagagcga

SEQ ID NO: 41462 - RNA, 20 nt, Artificial Sequence
  CIITA targeting sequence
caguucacugcaacuccgcc

SEQ ID NO: 41463 - RNA, 20 nt, Artificial Sequence
  CIITA targeting sequence
guucacugcaacuccgccuc

SEQ ID NO: 41464 - RNA, 20 nt, Artificial Sequence
  CIITA targeting sequence
cugcaacuccgccucccgag

SEQ ID NO: 41465 - RNA, 20 nt, Artificial Sequence
  CIITA targeting sequence
gccucccgaguucaagcaau

SEQ ID NO: 41466 - RNA, 20 nt, Artificial Sequence
  CIITA targeting sequence
cgaguucaagcaauucuccu

SEQ ID NO: 41467 - RNA, 20 nt, Artificial Sequence
  CIITA targeting sequence
ggaggcggaguugcagugaa

SEQ ID NO: 41468 - RNA, 20 nt, Artificial Sequence
  CIITA targeting sequence
agcaauucuccugccucagc

SEQ ID NO: 41469 - RNA, 20 nt, Artificial Sequence
  CIITA targeting sequence
ccugccucagccucucaagu

SEQ ID NO: 41470 - RNA, 20 nt, Artificial Sequence
  CIITA targeting sequence
ugccucagccucucaaguag

SEQ ID NO: 41471 - RNA, 20 nt, Artificial Sequence
  CIITA targeting sequence
gccucucaaguagcugggag

SEQ ID NO: 41472 - RNA, 20 nt, Artificial Sequence
  CIITA targeting sequence
caaguagcugggaguauagg

SEQ ID NO: 41473 - RNA, 20 nt, Artificial Sequence
  CIITA targeting sequence
aguagcugggaguauaggca

SEQ ID NO: 41474 - RNA, 20 nt, Artificial Sequence
  CIITA targeting sequence
cagcuacuugagaggcugag

SEQ ID NO: 41475 - RNA, 20 nt, Artificial Sequence
  CIITA targeting sequence
cacccggcuaauuuuguauu

SEQ ID NO: 41476 - RNA, 20 nt, Artificial Sequence
  CIITA targeting sequence
acuaaaaauacaaaauuagc

SEQ ID NO: 41477 - RNA, 20 nt, Artificial Sequence
  CIITA targeting sequence
cuacuaaaaauacaaaauua

SEQ ID NO: 41478 - RNA, 20 nt, Artificial Sequence
  CIITA targeting sequence
ccauguuggucaggcugguc

SEQ ID NO: 41479 - RNA, 20 nt, Artificial Sequence
  CIITA targeting sequence
auguuggucaggcuggucuc

SEQ ID NO: 41480 - RNA, 20 nt, Artificial Sequence
  CIITA targeting sequence
ggcuggucucaaacucccga

SEQ ID NO: 41481 - RNA, 20 nt, Artificial Sequence
  CIITA targeting sequence
caaacucccgaccuuaggug

SEQ ID NO: 41482 - RNA, 20 nt, Artificial Sequence
  CIITA targeting sequence
aacucccgaccuuaggugau

SEQ ID NO: 41483 - RNA, 20 nt, Artificial Sequence
  CIITA targeting sequence
cgaccuuaggugauccaccc

SEQ ID NO: 41484 - RNA, 20 nt, Artificial Sequence
  CIITA targeting sequence
ggaguuugagaccagccuga

SEQ ID NO: 41485 - RNA, 20 nt, Artificial Sequence
  CIITA targeting sequence
ccuaaggucgggaguuugag

SEQ ID NO: 41486 - RNA, 20 nt, Artificial Sequence
  CIITA targeting sequence
acccgccucggccuccaaag

SEQ ID NO: 41487 - RNA, 20 nt, Artificial Sequence
  CIITA targeting sequence
gccuccaaaguguuaggauu

SEQ ID NO: 41488 - RNA, 20 nt, Artificial Sequence
  CIITA targeting sequence
aaaguguuaggauuacaggc

SEQ ID NO: 41489 - RNA, 20 nt, Artificial Sequence
  CIITA targeting sequence
uaacacuuuggaggccgagg

SEQ ID NO: 41490 - RNA, 20 nt, Artificial Sequence
  CIITA targeting sequence
cgccuguaauccuaacacuu

SEQ ID NO: 41491 - RNA, 20 nt, Artificial Sequence
  CIITA targeting sequence
cuugcagggcugcauauaaa

SEQ ID NO: 41492 - RNA, 20 nt, Artificial Sequence
  CIITA targeting sequence
gaggcugaaucauggcaaag

SEQ ID NO: 41493 - RNA, 20 nt, Artificial Sequence
  CIITA targeting sequence
gaacucccuugcagggcugc

SEQ ID NO: 41494 - RNA, 20 nt, Artificial Sequence
  CIITA targeting sequence
gccucagaacucccuugcag

SEQ ID NO: 41495 - RNA, 20 nt, Artificial Sequence
  CIITA targeting sequence
uggcaaagucauggcccuga

SEQ ID NO: 41496 - RNA, 20 nt, Artificial Sequence
  CIITA targeting sequence
uggcccugaaaucauacccg

SEQ ID NO: 41497 - RNA, 20 nt, Artificial Sequence
  CIITA targeting sequence
gggccaugacuuugccauga

SEQ ID NO: 41498 - RNA, 20 nt, Artificial Sequence
  CIITA targeting sequence
uacccgcagcagcaccugac

SEQ ID NO: 41499 - RNA, 20 nt, Artificial Sequence
  CIITA targeting sequence
ggugcugcugcggguaugau

SEQ ID NO: 41500 - RNA, 20 nt, Artificial Sequence
  CIITA targeting sequence
aguaaacagcugaaguuggc

SEQ ID NO: 41501 - RNA, 20 nt, Artificial Sequence
  CIITA targeting sequence
acaccaagcagccuuuuaac

SEQ ID NO: 41502 - RNA, 20 nt, Artificial Sequence
  CIITA targeting sequence
gcuguuuacucgacaccaag

SEQ ID NO: 41503 - RNA, 20 nt, Artificial Sequence
  CIITA targeting sequence
gugacacucaucaugcuauu

SEQ ID NO: 41504 - RNA, 20 nt, Artificial Sequence
  CIITA targeting sequence
cugaugccaacuucagcugu

SEQ ID NO: 41505 - RNA, 20 nt, Artificial Sequence
  CIITA targeting sequence
ucaugcuauuuucacugcua

SEQ ID NO: 41506 - RNA, 20 nt, Artificial Sequence
  CIITA targeting sequence
ugcuauuuucacugcuacua

SEQ ID NO: 41507 - RNA, 20 nt, Artificial Sequence
  CIITA targeting sequence
cugcuacuaaugcugguugu

SEQ ID NO: 41508 - RNA, 20 nt, Artificial Sequence
  CIITA targeting sequence
caaccagcauuaguagcagu

SEQ ID NO: 41509 - RNA, 20 nt, Artificial Sequence
  CIITA targeting sequence
gcagcauauucacaaccagc

SEQ ID NO: 41510 - RNA, 20 nt, Artificial Sequence
  CIITA targeting sequence
aguuucugcagcauauucac

SEQ ID NO: 41511 - RNA, 20 nt, Artificial Sequence
  CIITA targeting sequence
agugacuggcuuuuucucuu

SEQ ID NO: 41512 - RNA, 20 nt, Artificial Sequence
  CIITA targeting sequence
cuggaccagcuccaguuucu

SEQ ID NO: 41513 - RNA, 20 nt, Artificial Sequence
  CIITA targeting sequence
cuuccugcccccagugcugg

SEQ ID NO: 41514 - RNA, 20 nt, Artificial Sequence
  CIITA targeting sequence
uccugcccccagugcugguc

SEQ ID NO: 41515 - RNA, 20 nt, Artificial Sequence
  CIITA targeting sequence
ugcccccagugcuggucaca

SEQ ID NO: 41516 - RNA, 20 nt, Artificial Sequence
  CIITA targeting sequence
cacccucuauguuaacucau

SEQ ID NO: 41517 - RNA, 20 nt, Artificial Sequence
  CIITA targeting sequence
auguuaacucaugcgacccu

SEQ ID NO: 41518 - RNA, 20 nt, Artificial Sequence
  CIITA targeting sequence
ugcgacccucaccaauguuc

SEQ ID NO: 41519 - RNA, 20 nt, Artificial Sequence
  CIITA targeting sequence
caugaguuaacauagagggu

SEQ ID NO: 41520 - RNA, 20 nt, Artificial Sequence
  CIITA targeting sequence
ccaauguuccugugauguag

SEQ ID NO: 41521 - RNA, 20 nt, Artificial Sequence
  CIITA targeting sequence
ugugauguagucagaaccau

SEQ ID NO: 41522 - RNA, 20 nt, Artificial Sequence
  CIITA targeting sequence
caggaacauuggugaggguc

SEQ ID NO: 41523 - RNA, 20 nt, Artificial Sequence
  CIITA targeting sequence
gaaccauagcuaacauuuag

SEQ ID NO: 41524 - RNA, 20 nt, Artificial Sequence
  CIITA targeting sequence
gacuacaucacaggaacauu

SEQ ID NO: 41525 - RNA, 20 nt, Artificial Sequence
  CIITA targeting sequence
uucuaggcaccaaggcaugu

SEQ ID NO: 41526 - RNA, 20 nt, Artificial Sequence
  CIITA targeting sequence
aggcaccaaggcauguucua

SEQ ID NO: 41527 - RNA, 20 nt, Artificial Sequence
  CIITA targeting sequence
aaauguuauaucagcauuga

SEQ ID NO: 41528 - RNA, 20 nt, Artificial Sequence
  CIITA targeting sequence
gcauugauucauuuacuccu

SEQ ID NO: 41529 - RNA, 20 nt, Artificial Sequence
  CIITA targeting sequence
augcugauauaacauuuaga

SEQ ID NO: 41530 - RNA, 20 nt, Artificial Sequence
  CIITA targeting sequence
uuuacuccuccccacaauga

SEQ ID NO: 41531 - RNA, 20 nt, Artificial Sequence
  CIITA targeting sequence
uccccacaaugacucuauca

SEQ ID NO: 41532 - RNA, 20 nt, Artificial Sequence
  CIITA targeting sequence
ccacaaugacucuaucaugc

SEQ ID NO: 41533 - RNA, 20 nt, Artificial Sequence
  CIITA targeting sequence
uuguggggaggaguaaauga

SEQ ID NO: 41534 - RNA, 20 nt, Artificial Sequence
  CIITA targeting sequence
aucaugcccauuuuacagau

SEQ ID NO: 41535 - RNA, 20 nt, Artificial Sequence
  CIITA targeting sequence
ugcccauuuuacagaugggc

SEQ ID NO: 41536 - RNA, 20 nt, Artificial Sequence
  CIITA targeting sequence
guaaaaugggcaugauagag

SEQ ID NO: 41537 - RNA, 20 nt, Artificial Sequence
  CIITA targeting sequence
guuugcccaucuguaaaaug

SEQ ID NO: 41538 - RNA, 20 nt, Artificial Sequence
  CIITA targeting sequence
cagaagaguugaguagcuug

SEQ ID NO: 41539 - RNA, 20 nt, Artificial Sequence
  CIITA targeting sequence
gaagaguugaguagcuugcc

SEQ ID NO: 41540 - RNA, 20 nt, Artificial Sequence
  CIITA targeting sequence
gagacucaguuugcccaucu

SEQ ID NO: 41541 - RNA, 20 nt, Artificial Sequence
  CIITA targeting sequence
ucugagacucaguuugccca

SEQ ID NO: 41542 - RNA, 20 nt, Artificial Sequence
  CIITA targeting sequence
acucuucugagacucaguuu

SEQ ID NO: 41543 - RNA, 20 nt, Artificial Sequence
  CIITA targeting sequence
cauaggcaguaagaggcaua

SEQ ID NO: 41544 - RNA, 20 nt, Artificial Sequence
  CIITA targeting sequence
uacugccuaugugaccuugg

SEQ ID NO: 41545 - RNA, 20 nt, Artificial Sequence
  CIITA targeting sequence
cagcuaugccucuuacugcc

SEQ ID NO: 41546 - RNA, 20 nt, Artificial Sequence
  CIITA targeting sequence
aaucccagcuaugccucuua

SEQ ID NO: 41547 - RNA, 20 nt, Artificial Sequence
  CIITA targeting sequence
caaguucaaaucccagcuau

SEQ ID NO: 41548 - RNA, 20 nt, Artificial Sequence
  CIITA targeting sequence
gacaguuuccacacaguaag

SEQ ID NO: 41549 - RNA, 20 nt, Artificial Sequence
  CIITA targeting sequence
gaacaacuucccaaguucaa

SEQ ID NO: 41550 - RNA, 20 nt, Artificial Sequence
  CIITA targeting sequence
acacaguaaggcaagaaaug

SEQ ID NO: 41551 - RNA, 20 nt, Artificial Sequence
  CIITA targeting sequence
ugccuuacuguguggaaacu

SEQ ID NO: 41552 - RNA, 20 nt, Artificial Sequence
  CIITA targeting sequence
uuucuugccuuacugugugg

SEQ ID NO: 41553 - RNA, 20 nt, Artificial Sequence
  CIITA targeting sequence
uuuuaguccugcuguuuucc

SEQ ID NO: 41554 - RNA, 20 nt, Artificial Sequence
  CIITA targeting sequence
ugcuguuuuccugggcucac

SEQ ID NO: 41555 - RNA, 20 nt, Artificial Sequence
  CIITA targeting sequence
ugggcucacuguuugaccac

SEQ ID NO: 41556 - RNA, 20 nt, Artificial Sequence
  CIITA targeting sequence
cuguuugaccacagagaagu

SEQ ID NO: 41557 - RNA, 20 nt, Artificial Sequence
  CIITA targeting sequence
aacagugagcccaggaaaac

SEQ ID NO: 41558 - RNA, 20 nt, Artificial Sequence
  CIITA targeting sequence
guggucaaacagugagccca

SEQ ID NO: 41559 - RNA, 20 nt, Artificial Sequence
  CIITA targeting sequence
cuguggucaaacagugagcc

SEQ ID NO: 41560 - RNA, 20 nt, Artificial Sequence
  CIITA targeting sequence
caacucucugggucuugguu

SEQ ID NO: 41561 - RNA, 20 nt, Artificial Sequence
  CIITA targeting sequence
acucucugggucuugguuug

SEQ ID NO: 41562 - RNA, 20 nt, Artificial Sequence
  CIITA targeting sequence
cugggucuugguuugccugu

SEQ ID NO: 41563 - RNA, 20 nt, Artificial Sequence
  CIITA targeting sequence
gggucuugguuugccugucu

SEQ ID NO: 41564 - RNA, 20 nt, Artificial Sequence
  CIITA targeting sequence
ugguuugccugucuuuaaaa

SEQ ID NO: 41565 - RNA, 20 nt, Artificial Sequence
  CIITA targeting sequence
uuaaaauggggcaguaaucc

SEQ ID NO: 41566 - RNA, 20 nt, Artificial Sequence
  CIITA targeting sequence
caguagguggugacucccac

SEQ ID NO: 41567 - RNA, 20 nt, Artificial Sequence
  CIITA targeting sequence
ccaccuacugggauuacugc

SEQ ID NO: 41568 - RNA, 20 nt, Artificial Sequence
  CIITA targeting sequence
cacggggcugaccuccaggc

SEQ ID NO: 41569 - RNA, 20 nt, Artificial Sequence
  CIITA targeting sequence
gccccgugggagucaccacc

SEQ ID NO: 41570 - RNA, 20 nt, Artificial Sequence
  CIITA targeting sequence
aggcugcaggggacacugag

SEQ ID NO: 41571 - RNA, 20 nt, Artificial Sequence
  CIITA targeting sequence
ccugcagccuggaggucagc

SEQ ID NO: 41572 - RNA, 20 nt, Artificial Sequence
  CIITA targeting sequence
guguccccugcagccuggag

SEQ ID NO: 41573 - RNA, 20 nt, Artificial Sequence
  CIITA targeting sequence
caguguccccugcagccugg

SEQ ID NO: 41574 - RNA, 20 nt, Artificial Sequence
  CIITA targeting sequence
uagaagcaaucaccacagcc

SEQ ID NO: 41575 - RNA, 20 nt, Artificial Sequence
  CIITA targeting sequence
aggaucucaguguccccugc

SEQ ID NO: 41576 - RNA, 20 nt, Artificial Sequence
  CIITA targeting sequence
ccacagcccugaacaagaga

SEQ ID NO: 41577 - RNA, 20 nt, Artificial Sequence
  CIITA targeting sequence
gggcuguggugauugcuucu

SEQ ID NO: 41578 - RNA, 20 nt, Artificial Sequence
  CIITA targeting sequence
uguucagggcuguggugauu

SEQ ID NO: 41579 - RNA, 20 nt, Artificial Sequence
  CIITA targeting sequence
cuuguucagggcugugguga

SEQ ID NO: 41580 - RNA, 20 nt, Artificial Sequence
  CIITA targeting sequence
cacuaguucucuuguucagg

SEQ ID NO: 41581 - RNA, 20 nt, Artificial Sequence
  CIITA targeting sequence
ccaggucccacuaguucucu

SEQ ID NO: 41582 - RNA, 20 nt, Artificial Sequence
  CIITA targeting sequence
guccccaggucccacuaguu

SEQ ID NO: 41583 - RNA, 20 nt, Artificial Sequence
  CIITA targeting sequence
aaguuucuguccccaggucc

SEQ ID NO: 41584 - RNA, 20 nt, Artificial Sequence
  CIITA targeting sequence
cuuauucauuccuagccucu

SEQ ID NO: 41585 - RNA, 20 nt, Artificial Sequence
  CIITA targeting sequence
uuccuagccucuauuuucau

SEQ ID NO: 41586 - RNA, 20 nt, Artificial Sequence
  CIITA targeting sequence
uagccucuauuuucauaucu

SEQ ID NO: 41587 - RNA, 20 nt, Artificial Sequence
  CIITA targeting sequence
auuuucauaucuagaaaaug

SEQ ID NO: 41588 - RNA, 20 nt, Artificial Sequence
  CIITA targeting sequence
uaucuagaaaaugggaacca

SEQ ID NO: 41589 - RNA, 20 nt, Artificial Sequence
  CIITA targeting sequence
agaaaaugggaaccauccca

SEQ ID NO: 41590 - RNA, 20 nt, Artificial Sequence
  CIITA targeting sequence
agauaugaaaauagaggcua

SEQ ID NO: 41591 - RNA, 20 nt, Artificial Sequence
  CIITA targeting sequence
cauuuucuagauaugaaaau

SEQ ID NO: 41592 - RNA, 20 nt, Artificial Sequence
  CIITA targeting sequence
caauggccuauguaaguacu

SEQ ID NO: 41593 - RNA, 20 nt, Artificial Sequence
  CIITA targeting sequence
guugugcaauaaauauugau

SEQ ID NO: 41594 - RNA, 20 nt, Artificial Sequence
  CIITA targeting sequence
auauuuauugcacaacagag

SEQ ID NO: 41595 - RNA, 20 nt, Artificial Sequence
  CIITA targeting sequence
uucccccagggauaguggga

SEQ ID NO: 41596 - RNA, 20 nt, Artificial Sequence
  CIITA targeting sequence
cccagggauagugggaccag

SEQ ID NO: 41597 - RNA, 20 nt, Artificial Sequence
  CIITA targeting sequence
cugggggaaggaaucaauau

SEQ ID NO: 41598 - RNA, 20 nt, Artificial Sequence
  CIITA targeting sequence
cacuaucccugggggaagga

SEQ ID NO: 41599 - RNA, 20 nt, Artificial Sequence
  CIITA targeting sequence
ggaaucuagggaugguggcu

SEQ ID NO: 41600 - RNA, 20 nt, Artificial Sequence
  CIITA targeting sequence
agaaaaagccuggucccacu

SEQ ID NO: 41601 - RNA, 20 nt, Artificial Sequence
  CIITA targeting sequence
agggaugguggcuucuggaa

SEQ ID NO: 41602 - RNA, 20 nt, Artificial Sequence
  CIITA targeting sequence
cuagauuccagaaaaagccu

SEQ ID NO: 41603 - RNA, 20 nt, Artificial Sequence
  CIITA targeting sequence
ggaaggcugaccaugcacag

SEQ ID NO: 41604 - RNA, 20 nt, Artificial Sequence
  CIITA targeting sequence
agaagccaccaucccuagau

SEQ ID NO: 41605 - RNA, 20 nt, Artificial Sequence
  CIITA targeting sequence
gccuuccagaagccaccauc

SEQ ID NO: 41606 - RNA, 20 nt, Artificial Sequence
  CIITA targeting sequence
aaucccucccccuggccucu

SEQ ID NO: 41607 - RNA, 20 nt, Artificial Sequence
  CIITA targeting sequence
cucccccuggccucuguuuc

SEQ ID NO: 41608 - RNA, 20 nt, Artificial Sequence
  CIITA targeting sequence
cccuggccucuguuuccgac

SEQ ID NO: 41609 - RNA, 20 nt, Artificial Sequence
  CIITA targeting sequence
guuuccgacagcuuguacaa

SEQ ID NO: 41610 - RNA, 20 nt, Artificial Sequence
  CIITA targeting sequence
gacagcuuguacaauaacug

SEQ ID NO: 41611 - RNA, 20 nt, Artificial Sequence
  CIITA targeting sequence
gaaacagaggccagggggag

SEQ ID NO: 41612 - RNA, 20 nt, Artificial Sequence
  CIITA targeting sequence
gcgacgugggagccgagagc

SEQ ID NO: 41613 - RNA, 20 nt, Artificial Sequence
  CIITA targeting sequence
cagaugcaguuauuguacaa

SEQ ID NO: 41614 - RNA, 20 nt, Artificial Sequence
  CIITA targeting sequence
cacgucgcagaugcaguuau

SEQ ID NO: 41615 - RNA, 20 nt, Artificial Sequence
  CIITA targeting sequence
gcucccacgucgcagaugca

SEQ ID NO: 41616 - RNA, 20 nt, Artificial Sequence
  CIITA targeting sequence
cggcucccacgucgcagaug

SEQ ID NO: 41617 - RNA, 20 nt, Artificial Sequence
  CIITA targeting sequence
ugugcuuccggacauggugu

SEQ ID NO: 41618 - RNA, 20 nt, Artificial Sequence
  CIITA targeting sequence
ggacauggugucccuccggg

SEQ ID NO: 41619 - RNA, 20 nt, Artificial Sequence
  CIITA targeting sequence
ggaagcacacgagccaagcu

SEQ ID NO: 41620 - RNA, 20 nt, Artificial Sequence
  CIITA targeting sequence
cuccgggugauggagugagu

SEQ ID NO: 41621 - RNA, 20 nt, Artificial Sequence
  CIITA targeting sequence
gggugauggagugagugugg

SEQ ID NO: 41622 - RNA, 20 nt, Artificial Sequence
  CIITA targeting sequence
cccggagggacaccaugucc

SEQ ID NO: 41623 - RNA, 20 nt, Artificial Sequence
  CIITA targeting sequence
aucacccggagggacaccau

SEQ ID NO: 41624 - RNA, 20 nt, Artificial Sequence
  CIITA targeting sequence
cuccaucacccggagggaca

SEQ ID NO: 41625 - RNA, 20 nt, Artificial Sequence
  CIITA targeting sequence
cacacucacuccaucacccg

SEQ ID NO: 41626 - RNA, 20 nt, Artificial Sequence
  CIITA targeting sequence
gggcgguggguggcucagcc

SEQ ID NO: 41627 - RNA, 20 nt, Artificial Sequence
  CIITA targeting sequence
gcccggggugggagacacug

SEQ ID NO: 41628 - RNA, 20 nt, Artificial Sequence
  CIITA targeting sequence
caccccgggcugagccaccc

SEQ ID NO: 41629 - RNA, 20 nt, Artificial Sequence
  CIITA targeting sequence
cccaccccgggcugagccac

SEQ ID NO: 41630 - RNA, 20 nt, Artificial Sequence
  CIITA targeting sequence
gugucucccaccccgggcug

SEQ ID NO: 41631 - RNA, 20 nt, Artificial Sequence
  CIITA targeting sequence
cucccugguguccuggaaga

SEQ ID NO: 41632 - RNA, 20 nt, Artificial Sequence
  CIITA targeting sequence
cccugguguccuggaagagc

SEQ ID NO: 41633 - RNA, 20 nt, Artificial Sequence
  CIITA targeting sequence
cugguguccuggaagagcug

SEQ ID NO: 41634 - RNA, 20 nt, Artificial Sequence
  CIITA targeting sequence
uggaagagcuggaugugggg

SEQ ID NO: 41635 - RNA, 20 nt, Artificial Sequence
  CIITA targeting sequence
aggacaccagggagagacuu

SEQ ID NO: 41636 - RNA, 20 nt, Artificial Sequence
  CIITA targeting sequence
uccaggacaccagggagaga

SEQ ID NO: 41637 - RNA, 20 nt, Artificial Sequence
  CIITA targeting sequence
agcucuuccaggacaccagg

SEQ ID NO: 41638 - RNA, 20 nt, Artificial Sequence
  CIITA targeting sequence
ggagcuggggagucccaagg

SEQ ID NO: 41639 - RNA, 20 nt, Artificial Sequence
  CIITA targeting sequence
agaccaaggccacccccaca

SEQ ID NO: 41640 - RNA, 20 nt, Artificial Sequence
  CIITA targeting sequence
ccagcuccagaccaaggcca

SEQ ID NO: 41641 - RNA, 20 nt, Artificial Sequence
  CIITA targeting sequence
caagggccaggccccaaggu

SEQ ID NO: 41642 - RNA, 20 nt, Artificial Sequence
  CIITA targeting sequence
ccuuggggccuggcccuugg

SEQ ID NO: 41643 - RNA, 20 nt, Artificial Sequence
  CIITA targeting sequence
cuugccagcguccaguacaa

SEQ ID NO: 41644 - RNA, 20 nt, Artificial Sequence
  CIITA targeting sequence
ugccagcguccaguacaaca

SEQ ID NO: 41645 - RNA, 20 nt, Artificial Sequence
  CIITA targeting sequence
aguacaacaaguucacggcu

SEQ ID NO: 41646 - RNA, 20 nt, Artificial Sequence
  CIITA targeting sequence
cggcugccggggcccagcag

SEQ ID NO: 41647 - RNA, 20 nt, Artificial Sequence
  CIITA targeting sequence
cugccagccuucggaggugu

SEQ ID NO: 41648 - RNA, 20 nt, Artificial Sequence
  CIITA targeting sequence
gagguguccucauguggaga

SEQ ID NO: 41649 - RNA, 20 nt, Artificial Sequence
  CIITA targeting sequence
gaaggcuggcagcgagcugc

SEQ ID NO: 41650 - RNA, 20 nt, Artificial Sequence
  CIITA targeting sequence
ucauguggagacgcuggcgu

SEQ ID NO: 41651 - RNA, 20 nt, Artificial Sequence
  CIITA targeting sequence
uguggagacgcuggcguaag

SEQ ID NO: 41652 - RNA, 20 nt, Artificial Sequence
  CIITA targeting sequence
acaugaggacaccuccgaag

SEQ ID NO: 41653 - RNA, 20 nt, Artificial Sequence
  CIITA targeting sequence
ccacaugaggacaccuccga

SEQ ID NO: 41654 - RNA, 20 nt, Artificial Sequence
  CIITA targeting sequence
aggcaacccuggugggugga

SEQ ID NO: 41655 - RNA, 20 nt, Artificial Sequence
  CIITA targeting sequence
acccaccaggguugccugga

SEQ ID NO: 41656 - RNA, 20 nt, Artificial Sequence
  CIITA targeting sequence
ccacccaccaggguugccug

SEQ ID NO: 41657 - RNA, 20 nt, Artificial Sequence
  CIITA targeting sequence
cuccccaggcguguggccca

SEQ ID NO: 41658 - RNA, 20 nt, Artificial Sequence
  CIITA targeting sequence
ccaggcguguggcccagugu

SEQ ID NO: 41659 - RNA, 20 nt, Artificial Sequence
  CIITA targeting sequence
cacugggccacacgccuggg

SEQ ID NO: 41660 - RNA, 20 nt, Artificial Sequence
  CIITA targeting sequence
ggggucacacugggccacac

SEQ ID NO: 41661 - RNA, 20 nt, Artificial Sequence
  CIITA targeting sequence
aaucaugcucuucccuucac

SEQ ID NO: 41662 - RNA, 20 nt, Artificial Sequence
  CIITA targeting sequence
ugcucuucccuucaccaauc

SEQ ID NO: 41663 - RNA, 20 nt, Artificial Sequence
  CIITA targeting sequence
ucccuucaccaaucugcaac

SEQ ID NO: 41664 - RNA, 20 nt, Artificial Sequence
  CIITA targeting sequence
cuucaccaaucugcaacccu

SEQ ID NO: 41665 - RNA, 20 nt, Artificial Sequence
  CIITA targeting sequence
ccaaucugcaacccugggug

SEQ ID NO: 41666 - RNA, 20 nt, Artificial Sequence
  CIITA targeting sequence
gcaacccugggugagcagac

SEQ ID NO: 41667 - RNA, 20 nt, Artificial Sequence
  CIITA targeting sequence
cccaggguugcagauuggug

SEQ ID NO: 41668 - RNA, 20 nt, Artificial Sequence
  CIITA targeting sequence
gcucacccaggguugcagau

SEQ ID NO: 41669 - RNA, 20 nt, Artificial Sequence
  CIITA targeting sequence
cccucuggcuucagcuucuu

SEQ ID NO: 41670 - RNA, 20 nt, Artificial Sequence
  CIITA targeting sequence
ggcuucagcuucuucaucug

SEQ ID NO: 41671 - RNA, 20 nt, Artificial Sequence
  CIITA targeting sequence
gcuucuucaucuguaaagug

SEQ ID NO: 41672 - RNA, 20 nt, Artificial Sequence
  CIITA targeting sequence
ucaucuguaaaguggggaca

SEQ ID NO: 41673 - RNA, 20 nt, Artificial Sequence
  CIITA targeting sequence
ucuguaaaguggggacagua

SEQ ID NO: 41674 - RNA, 20 nt, Artificial Sequence
  CIITA targeting sequence
guaaaguggggacaguaaua

SEQ ID NO: 41675 - RNA, 20 nt, Artificial Sequence
  CIITA targeting sequence
ccacuuuacagaugaagaag

SEQ ID NO: 41676 - RNA, 20 nt, Artificial Sequence
  CIITA targeting sequence
acccaagagguuuugugagg

SEQ ID NO: 41677 - RNA, 20 nt, Artificial Sequence
  CIITA targeting sequence
uggguggauauuauuacugu

SEQ ID NO: 41678 - RNA, 20 nt, Artificial Sequence
  CIITA targeting sequence
caaaaccucuuggguggaua

SEQ ID NO: 41679 - RNA, 20 nt, Artificial Sequence
  CIITA targeting sequence
agcccuacaaagcucuuaua

SEQ ID NO: 41680 - RNA, 20 nt, Artificial Sequence
  CIITA targeting sequence
uauaacaacaguagcuggca

SEQ ID NO: 41681 - RNA, 20 nt, Artificial Sequence
  CIITA targeting sequence
gccuaauauagcauuuauug

SEQ ID NO: 41682 - RNA, 20 nt, Artificial Sequence
  CIITA targeting sequence
uaugguucagccuaauauag

SEQ ID NO: 41683 - RNA, 20 nt, Artificial Sequence
  CIITA targeting sequence
gcaauuucauaugguucagc

SEQ ID NO: 41684 - RNA, 20 nt, Artificial Sequence
  CIITA targeting sequence
acccauuuuugaccuguaaa

SEQ ID NO: 41685 - RNA, 20 nt, Artificial Sequence
  CIITA targeting sequence
aaaauggguggaugucagca

SEQ ID NO: 41686 - RNA, 20 nt, Artificial Sequence
  CIITA targeting sequence
uaugguucagguuuaucuuu

SEQ ID NO: 41687 - RNA, 20 nt, Artificial Sequence
  CIITA targeting sequence
gguuuaucuuuuauuaaguc

SEQ ID NO: 41688 - RNA, 20 nt, Artificial Sequence
  CIITA targeting sequence
uuuauuaagucaccaugaug

SEQ ID NO: 41689 - RNA, 20 nt, Artificial Sequence
  CIITA targeting sequence
ccaugauguccaauacuggu

SEQ ID NO: 41690 - RNA, 20 nt, Artificial Sequence
  CIITA targeting sequence
uggugacuuaauaaaagaua

SEQ ID NO: 41691 - RNA, 20 nt, Artificial Sequence
  CIITA targeting sequence
aauacugguuacuuuauauu

SEQ ID NO: 41692 - RNA, 20 nt, Artificial Sequence
  CIITA targeting sequence
uucaaagcacuuuuaucucc

SEQ ID NO: 41693 - RNA, 20 nt, Artificial Sequence
  CIITA targeting sequence
aagcacuuuuaucuccacaa

SEQ ID NO: 41694 - RNA, 20 nt, Artificial Sequence
  CIITA targeting sequence
ccacaaucacucaccucuuc

SEQ ID NO: 41695 - RNA, 20 nt, Artificial Sequence
  CIITA targeting sequence
acaaucacucaccucuucua

SEQ ID NO: 41696 - RNA, 20 nt, Artificial Sequence
  CIITA targeting sequence
cucaccucuucuaagacgca

SEQ ID NO: 41697 - RNA, 20 nt, Artificial Sequence
  CIITA targeting sequence
ccucuucuaagacgcacagg

SEQ ID NO: 41698 - RNA, 20 nt, Artificial Sequence
  CIITA targeting sequence
ucuaagacgcacaggguggg

SEQ ID NO: 41699 - RNA, 20 nt, Artificial Sequence
  CIITA targeting sequence
aagacgcacagggugggucu

SEQ ID NO: 41700 - RNA, 20 nt, Artificial Sequence
  CIITA targeting sequence
uagaagaggugagugauugu

SEQ ID NO: 41701 - RNA, 20 nt, Artificial Sequence
  CIITA targeting sequence
uacaagacccauuuuacaga

SEQ ID NO: 41702 - RNA, 20 nt, Artificial Sequence
  CIITA targeting sequence
uguaagacccacccugugcg

SEQ ID NO: 41703 - RNA, 20 nt, Artificial Sequence
  CIITA targeting sequence
guaaaaugggucuuguaaga

SEQ ID NO: 41704 - RNA, 20 nt, Artificial Sequence
  CIITA targeting sequence
ucuguaaaaugggucuugua

SEQ ID NO: 41705 - RNA, 20 nt, Artificial Sequence
  CIITA targeting sequence
ucaucuguaaaaugggucuu

SEQ ID NO: 41706 - RNA, 20 nt, Artificial Sequence
  CIITA targeting sequence
gugcuuuauuuuccucaucu

SEQ ID NO: 41707 - RNA, 20 nt, Artificial Sequence
  CIITA targeting sequence
ggggucacacagcaagucag

SEQ ID NO: 41708 - RNA, 20 nt, Artificial Sequence
  CIITA targeting sequence
cacagcaagucagcugcaga

SEQ ID NO: 41709 - RNA, 20 nt, Artificial Sequence
  CIITA targeting sequence
gcugcagaaccauaaaggaa

SEQ ID NO: 41710 - RNA, 20 nt, Artificial Sequence
  CIITA targeting sequence
gcagcugacuugcuguguga

SEQ ID NO: 41711 - RNA, 20 nt, Artificial Sequence
  CIITA targeting sequence
uuuaugguucugcagcugac

SEQ ID NO: 41712 - RNA, 20 nt, Artificial Sequence
  CIITA targeting sequence
cgggccuccuaggcuucucc

SEQ ID NO: 41713 - RNA, 20 nt, Artificial Sequence
  CIITA targeting sequence
ggccuccuaggcuucuccuu

SEQ ID NO: 41714 - RNA, 20 nt, Artificial Sequence
  CIITA targeting sequence
uaggcuucuccuuuucccca

SEQ ID NO: 41715 - RNA, 20 nt, Artificial Sequence
  CIITA targeting sequence
ccuuuuccccaugacccaca

SEQ ID NO: 41716 - RNA, 20 nt, Artificial Sequence
  CIITA targeting sequence
uuuuccccaugacccacacc

SEQ ID NO: 41717 - RNA, 20 nt, Artificial Sequence
  CIITA targeting sequence
ccaugacccacaccggucgg

SEQ ID NO: 41718 - RNA, 20 nt, Artificial Sequence
  CIITA targeting sequence
uggggaaaaggagaagccua

SEQ ID NO: 41719 - RNA, 20 nt, Artificial Sequence
  CIITA targeting sequence
guaucuugccaggggaaaag

SEQ ID NO: 41720 - RNA, 20 nt, Artificial Sequence
  CIITA targeting sequence
ugccaggggaaaagucccca

SEQ ID NO: 41721 - RNA, 20 nt, Artificial Sequence
  CIITA targeting sequence
ccuggcaagauaccgaccgg

SEQ ID NO: 41722 - RNA, 20 nt, Artificial Sequence
  CIITA targeting sequence
ccaacguucuaggcugggug

SEQ ID NO: 41723 - RNA, 20 nt, Artificial Sequence
  CIITA targeting sequence
aggcuggguggaaggaggga

SEQ ID NO: 41724 - RNA, 20 nt, Artificial Sequence
  CIITA targeting sequence
acccagccuagaacguuggg

SEQ ID NO: 41725 - RNA, 20 nt, Artificial Sequence
  CIITA targeting sequence
uuccacccagccuagaacgu

SEQ ID NO: 41726 - RNA, 20 nt, Artificial Sequence
  CIITA targeting sequence
cuccuuccacccagccuaga

SEQ ID NO: 41727 - RNA, 20 nt, Artificial Sequence
  CIITA targeting sequence
cuggggccccaggccgcccu

SEQ ID NO: 41728 - RNA, 20 nt, Artificial Sequence
  CIITA targeting sequence
cuccucuaaccuggcucuga

SEQ ID NO: 41729 - RNA, 20 nt, Artificial Sequence
  CIITA targeting sequence
ccucuaaccuggcucugagu

SEQ ID NO: 41730 - RNA, 20 nt, Artificial Sequence
  CIITA targeting sequence
ucuaaccuggcucugagucc

SEQ ID NO: 41731 - RNA, 20 nt, Artificial Sequence
  CIITA targeting sequence
aaccuggcucugagucccau

SEQ ID NO: 41732 - RNA, 20 nt, Artificial Sequence
  CIITA targeting sequence
gagucccauccccccuugca

SEQ ID NO: 41733 - RNA, 20 nt, Artificial Sequence
  CIITA targeting sequence
gagccagguuagaggagaga

SEQ ID NO: 41734 - RNA, 20 nt, Artificial Sequence
  CIITA targeting sequence
cauccccccuugcaggaugu

SEQ ID NO: 41735 - RNA, 20 nt, Artificial Sequence
  CIITA targeting sequence
ccccuugcaggauguggacg

SEQ ID NO: 41736 - RNA, 20 nt, Artificial Sequence
  CIITA targeting sequence
ugcaaggggggaugggacuc

SEQ ID NO: 41737 - RNA, 20 nt, Artificial Sequence
  CIITA targeting sequence
acauccugcaaggggggaug

SEQ ID NO: 41738 - RNA, 20 nt, Artificial Sequence
  CIITA targeting sequence
cauucaguguccaggaacac

SEQ ID NO: 41739 - RNA, 20 nt, Artificial Sequence
  CIITA targeting sequence
guguccaggaacaccugcaa

SEQ ID NO: 41740 - RNA, 20 nt, Artificial Sequence
  CIITA targeting sequence
aggaacaccugcaacaacag

SEQ ID NO: 41741 - RNA, 20 nt, Artificial Sequence
  CIITA targeting sequence
uggacacugaaugggauggu

SEQ ID NO: 41742 - RNA, 20 nt, Artificial Sequence
  CIITA targeting sequence
uguuguugcagguguuccug

SEQ ID NO: 41743 - RNA, 20 nt, Artificial Sequence
  CIITA targeting sequence
cggaucagccugagaugauc

SEQ ID NO: 41744 - RNA, 20 nt, Artificial Sequence
  CIITA targeting sequence
gugaauccuguuguugcagg

SEQ ID NO: 41745 - RNA, 20 nt, Artificial Sequence
  CIITA targeting sequence
gccugagaugaucccagcug

SEQ ID NO: 41746 - RNA, 20 nt, Artificial Sequence
  CIITA targeting sequence
ggcugauccgugaauccugu

SEQ ID NO: 41747 - RNA, 20 nt, Artificial Sequence
  CIITA targeting sequence
caggcugauccgugaauccu

SEQ ID NO: 41748 - RNA, 20 nt, Artificial Sequence
  CIITA targeting sequence
ucucaggcugauccgugaau

SEQ ID NO: 41749 - RNA, 20 nt, Artificial Sequence
  CIITA targeting sequence
cagcugugcucuggacaggg

SEQ ID NO: 41750 - RNA, 20 nt, Artificial Sequence
  CIITA targeting sequence
ggacaggguaaccagggugg

SEQ ID NO: 41751 - RNA, 20 nt, Artificial Sequence
  CIITA targeting sequence
agagcacagcugggaucauc

SEQ ID NO: 41752 - RNA, 20 nt, Artificial Sequence
  CIITA targeting sequence
caagcccacccugguuaccc

SEQ ID NO: 41753 - RNA, 20 nt, Artificial Sequence
  CIITA targeting sequence
ccucccaagcccacccuggu

SEQ ID NO: 41754 - RNA, 20 nt, Artificial Sequence
  CIITA targeting sequence
ccccucccaagcccacccug

SEQ ID NO: 41755 - RNA, 20 nt, Artificial Sequence
  CIITA targeting sequence
uugugaagguggcauucaaa

SEQ ID NO: 41756 - RNA, 20 nt, Artificial Sequence
  CIITA targeting sequence
caaggacacugcccccaacc

SEQ ID NO: 41757 - RNA, 20 nt, Artificial Sequence
  CIITA targeting sequence
aaaaaugugggcgggacaca

SEQ ID NO: 41758 - RNA, 20 nt, Artificial Sequence
  CIITA targeting sequence
cgcccacauuuuuugaaugc

SEQ ID NO: 41759 - RNA, 20 nt, Artificial Sequence
  CIITA targeting sequence
aagggugguggccuagcccc

SEQ ID NO: 41760 - RNA, 20 nt, Artificial Sequence
  CIITA targeting sequence
ucagagacauccccucaucu

SEQ ID NO: 41761 - RNA, 20 nt, Artificial Sequence
  CIITA targeting sequence
gagacauccccucaucucca

SEQ ID NO: 41762 - RNA, 20 nt, Artificial Sequence
  CIITA targeting sequence
gaugacgcaugcguccaagg

SEQ ID NO: 41763 - RNA, 20 nt, Artificial Sequence
  CIITA targeting sequence
cugaugacgcaugcguccaa

SEQ ID NO: 41764 - RNA, 20 nt, Artificial Sequence
  CIITA targeting sequence
ccucaucuccacccugggcu

SEQ ID NO: 41765 - RNA, 20 nt, Artificial Sequence
  CIITA targeting sequence
ucuccacccugggcucggug

SEQ ID NO: 41766 - RNA, 20 nt, Artificial Sequence
  CIITA targeting sequence
ccacccugggcucgguggag

SEQ ID NO: 41767 - RNA, 20 nt, Artificial Sequence
  CIITA targeting sequence
acccugggcucgguggagcu

SEQ ID NO: 41768 - RNA, 20 nt, Artificial Sequence
  CIITA targeting sequence
guggagcuguccuccaggcu

SEQ ID NO: 41769 - RNA, 20 nt, Artificial Sequence
  CIITA targeting sequence
accgagcccaggguggagau

SEQ ID NO: 41770 - RNA, 20 nt, Artificial Sequence
  CIITA targeting sequence
uccaggcuuugcgagcuugg

SEQ ID NO: 41771 - RNA, 20 nt, Artificial Sequence
  CIITA targeting sequence
aggcuuugcgagcuuggucc

SEQ ID NO: 41772 - RNA, 20 nt, Artificial Sequence
  CIITA targeting sequence
caaagccuggaggacagcuc

SEQ ID NO: 41773 - RNA, 20 nt, Artificial Sequence
  CIITA targeting sequence
cuguggucaggcuuagagau

SEQ ID NO: 41774 - RNA, 20 nt, Artificial Sequence
  CIITA targeting sequence
ggcuuagagaucaggggaca

SEQ ID NO: 41775 - RNA, 20 nt, Artificial Sequence
  CIITA targeting sequence
aagccugaccacagggacca

SEQ ID NO: 41776 - RNA, 20 nt, Artificial Sequence
  CIITA targeting sequence
cuaagccugaccacagggac

SEQ ID NO: 41777 - RNA, 20 nt, Artificial Sequence
  CIITA targeting sequence
ggggacaggaaaguuggcca

SEQ ID NO: 41778 - RNA, 20 nt, Artificial Sequence
  CIITA targeting sequence
ccugaucucuaagccugacc

SEQ ID NO: 41779 - RNA, 20 nt, Artificial Sequence
  CIITA targeting sequence
uguccccugaucucuaagcc

SEQ ID NO: 41780 - RNA, 20 nt, Artificial Sequence
  CIITA targeting sequence
acaucccacagccucagugc

SEQ ID NO: 41781 - RNA, 20 nt, Artificial Sequence
  CIITA targeting sequence
cacagccucagugcuuggaa

SEQ ID NO: 41782 - RNA, 20 nt, Artificial Sequence
  CIITA targeting sequence
gugcuuggaagagcuuccuu

SEQ ID NO: 41783 - RNA, 20 nt, Artificial Sequence
  CIITA targeting sequence
aagcacugaggcugugggau

SEQ ID NO: 41784 - RNA, 20 nt, Artificial Sequence
  CIITA targeting sequence
uccaagcacugaggcugugg

SEQ ID NO: 41785 - RNA, 20 nt, Artificial Sequence
  CIITA targeting sequence
uuuggggacuccaagccuuc

SEQ ID NO: 41786 - RNA, 20 nt, Artificial Sequence
  CIITA targeting sequence
ccaaaggaagcucuuccaag

SEQ ID NO: 41787 - RNA, 20 nt, Artificial Sequence
  CIITA targeting sequence
aagccuucccagcugcuguu

SEQ ID NO: 41788 - RNA, 20 nt, Artificial Sequence
  CIITA targeting sequence
cagcugcuguuucggcuugg

SEQ ID NO: 41789 - RNA, 20 nt, Artificial Sequence
  CIITA targeting sequence
gcuugguggcugcccugaug

SEQ ID NO: 41790 - RNA, 20 nt, Artificial Sequence
  CIITA targeting sequence
gggcagccaccaagccgaaa

SEQ ID NO: 41791 - RNA, 20 nt, Artificial Sequence
  CIITA targeting sequence
ggguuugucucagaugaacu

SEQ ID NO: 41792 - RNA, 20 nt, Artificial Sequence
  CIITA targeting sequence
cagaugaacuugcuugacaa

SEQ ID NO: 41793 - RNA, 20 nt, Artificial Sequence
  CIITA targeting sequence
gaugaacuugcuugacaagu

SEQ ID NO: 41794 - RNA, 20 nt, Artificial Sequence
  CIITA targeting sequence
gagacaaacccggagcauca

SEQ ID NO: 41795 - RNA, 20 nt, Artificial Sequence
  CIITA targeting sequence
ucugagacaaacccggagca

SEQ ID NO: 41796 - RNA, 20 nt, Artificial Sequence
  CIITA targeting sequence
agcaaguucaucugagacaa

SEQ ID NO: 41797 - RNA, 20 nt, Artificial Sequence
  CIITA targeting sequence
ccugcuccucacuaugaaga

SEQ ID NO: 41798 - RNA, 20 nt, Artificial Sequence
  CIITA targeting sequence
ugcuccucacuaugaagauc

SEQ ID NO: 41799 - RNA, 20 nt, Artificial Sequence
  CIITA targeting sequence
ucacuaugaagaucacuguc

SEQ ID NO: 41800 - RNA, 20 nt, Artificial Sequence
  CIITA targeting sequence
cuaugaagaucacugucccc

SEQ ID NO: 41801 - RNA, 20 nt, Artificial Sequence
  CIITA targeting sequence
uagugaggagcaggagacuu

SEQ ID NO: 41802 - RNA, 20 nt, Artificial Sequence
  CIITA targeting sequence
ucauagugaggagcaggaga

SEQ ID NO: 41803 - RNA, 20 nt, Artificial Sequence
  CIITA targeting sequence
cugucccccagcccugugcu

SEQ ID NO: 41804 - RNA, 20 nt, Artificial Sequence
  CIITA targeting sequence
cccagcccugugcuccccgc

SEQ ID NO: 41805 - RNA, 20 nt, Artificial Sequence
  CIITA targeting sequence
ccgcacugugcugcacgucc

SEQ ID NO: 41806 - RNA, 20 nt, Artificial Sequence
  CIITA targeting sequence
accuccauuccacugccccu

SEQ ID NO: 41807 - RNA, 20 nt, Artificial Sequence
  CIITA targeting sequence
auuccacugccccucccauc

SEQ ID NO: 41808 - RNA, 20 nt, Artificial Sequence
  CIITA targeting sequence
acugccccucccaucccccc

SEQ ID NO: 41809 - RNA, 20 nt, Artificial Sequence
  CIITA targeting sequence
cauccccccaucuugauagc

SEQ ID NO: 41810 - RNA, 20 nt, Artificial Sequence
  CIITA targeting sequence
ccccaucuugauagcacccu

SEQ ID NO: 41811 - RNA, 20 nt, Artificial Sequence
  CIITA targeting sequence
ugauagcacccuucccaggu

SEQ ID NO: 41812 - RNA, 20 nt, Artificial Sequence
  CIITA targeting sequence
agauggggggaugggagggg

SEQ ID NO: 41813 - RNA, 20 nt, Artificial Sequence
  CIITA targeting sequence
caggugucaagcugccccuc

SEQ ID NO: 41814 - RNA, 20 nt, Artificial Sequence
  CIITA targeting sequence
agcugccccuccuagagugu

SEQ ID NO: 41815 - RNA, 20 nt, Artificial Sequence
  CIITA targeting sequence
uagaguguccugccuaaacc

SEQ ID NO: 41816 - RNA, 20 nt, Artificial Sequence
  CIITA targeting sequence
aggaggggcagcuugacacc

SEQ ID NO: 41817 - RNA, 20 nt, Artificial Sequence
  CIITA targeting sequence
ugccuaaacccccucuccug

SEQ ID NO: 41818 - RNA, 20 nt, Artificial Sequence
  CIITA targeting sequence
ccuggcuccucccgcuacag

SEQ ID NO: 41819 - RNA, 20 nt, Artificial Sequence
  CIITA targeting sequence
uggcuccucccgcuacagca

SEQ ID NO: 41820 - RNA, 20 nt, Artificial Sequence
  CIITA targeting sequence
ucccgcuacagcauguucuc

SEQ ID NO: 41821 - RNA, 20 nt, Artificial Sequence
  CIITA targeting sequence
cgcuacagcauguucucuga

SEQ ID NO: 41822 - RNA, 20 nt, Artificial Sequence
  CIITA targeting sequence
cugaggacacuaaccacgcu

SEQ ID NO: 41823 - RNA, 20 nt, Artificial Sequence
  CIITA targeting sequence
gaggacacuaaccacgcugg

SEQ ID NO: 41824 - RNA, 20 nt, Artificial Sequence
  CIITA targeting sequence
gagaacaugcuguagcggga

SEQ ID NO: 41825 - RNA, 20 nt, Artificial Sequence
  CIITA targeting sequence
ucagagaacaugcuguagcg

SEQ ID NO: 41826 - RNA, 20 nt, Artificial Sequence
  CIITA targeting sequence
agcgugguuaguguccucag

SEQ ID NO: 41827 - RNA, 20 nt, Artificial Sequence
  CIITA targeting sequence
agguccagcgugguuagugu

SEQ ID NO: 41828 - RNA, 20 nt, Artificial Sequence
  CIITA targeting sequence
acaaguacccaguucaaggu

SEQ ID NO: 41829 - RNA, 20 nt, Artificial Sequence
  CIITA targeting sequence
ucuccaggcuguaucccaug

SEQ ID NO: 41830 - RNA, 20 nt, Artificial Sequence
  CIITA targeting sequence
ccaggcuguaucccaugagc

SEQ ID NO: 41831 - RNA, 20 nt, Artificial Sequence
  CIITA targeting sequence
aggcuguaucccaugagccu

SEQ ID NO: 41832 - RNA, 20 nt, Artificial Sequence
  CIITA targeting sequence
caugagccucagcauccugg

SEQ ID NO: 41833 - RNA, 20 nt, Artificial Sequence
  CIITA targeting sequence
ugggauacagccuggagaag

SEQ ID NO: 41834 - RNA, 20 nt, Artificial Sequence
  CIITA targeting sequence
gcauccuggcacccggcccc

SEQ ID NO: 41835 - RNA, 20 nt, Artificial Sequence
  CIITA targeting sequence
uggcacccggccccugcugg

SEQ ID NO: 41836 - RNA, 20 nt, Artificial Sequence
  CIITA targeting sequence
ggguuggccccugcccggcu

SEQ ID NO: 41837 - RNA, 20 nt, Artificial Sequence
  CIITA targeting sequence
gcagccgggcaggggccaac

SEQ ID NO: 41838 - RNA, 20 nt, Artificial Sequence
  CIITA targeting sequence
uuccgcagccgggcaggggc

SEQ ID NO: 41839 - RNA, 20 nt, Artificial Sequence
  CIITA targeting sequence
ugcucugcugacagacacag

SEQ ID NO: 41840 - RNA, 20 nt, Artificial Sequence
  CIITA targeting sequence
gcugacagacacaggcccgg

SEQ ID NO: 41841 - RNA, 20 nt, Artificial Sequence
  CIITA targeting sequence
gcagagcaagaugugguuca

SEQ ID NO: 41842 - RNA, 20 nt, Artificial Sequence
  CIITA targeting sequence
gucagcagagcaagaugugg

SEQ ID NO: 41843 - RNA, 20 nt, Artificial Sequence
  CIITA targeting sequence
aggcuccuuuagcgcccagu

SEQ ID NO: 41844 - RNA, 20 nt, Artificial Sequence
  CIITA targeting sequence
uuuagcgcccaguugggugg

SEQ ID NO: 41845 - RNA, 20 nt, Artificial Sequence
  CIITA targeting sequence
acccaacugggcgcuaaagg

SEQ ID NO: 41846 - RNA, 20 nt, Artificial Sequence
  CIITA targeting sequence
acccaggagccccgaggccu

SEQ ID NO: 41847 - RNA, 20 nt, Artificial Sequence
  CIITA targeting sequence
uggguggaccgcagcugcca

SEQ ID NO: 41848 - RNA, 20 nt, Artificial Sequence
  CIITA targeting sequence
gggcuccuggguggaccgca

SEQ ID NO: 41849 - RNA, 20 nt, Artificial Sequence
  CIITA targeting sequence
cugaaggacauugcggacag

SEQ ID NO: 41850 - RNA, 20 nt, Artificial Sequence
  CIITA targeting sequence
gaaggacauugcggacagcc

SEQ ID NO: 41851 - RNA, 20 nt, Artificial Sequence
  CIITA targeting sequence
gagaaggccucggggcuccu

SEQ ID NO: 41852 - RNA, 20 nt, Artificial Sequence
  CIITA targeting sequence
uucagagaaggccucggggc

SEQ ID NO: 41853 - RNA, 20 nt, Artificial Sequence
  CIITA targeting sequence
gcaauguccuucagagaagg

SEQ ID NO: 41854 - RNA, 20 nt, Artificial Sequence
  CIITA targeting sequence
ggccuggccguggcuguccg

SEQ ID NO: 41855 - RNA, 20 nt, Artificial Sequence
  CIITA targeting sequence
cucuggccuggccguggcug

SEQ ID NO: 41856 - RNA, 20 nt, Artificial Sequence
  CIITA targeting sequence
cucccucuggccuggccgug

SEQ ID NO: 41857 - RNA, 20 nt, Artificial Sequence
  CIITA targeting sequence
gucacucccucuggccuggc

SEQ ID NO: 41858 - RNA, 20 nt, Artificial Sequence
  CIITA targeting sequence
gccugcccaggccccugcca

SEQ ID NO: 41859 - RNA, 20 nt, Artificial Sequence
  CIITA targeting sequence
ccaggguggcaggggccugg

SEQ ID NO: 41860 - RNA, 20 nt, Artificial Sequence
  CIITA targeting sequence
ccccaggguggcaggggccu

SEQ ID NO: 41861 - RNA, 20 nt, Artificial Sequence
  CIITA targeting sequence
uuuuuuuuauuuuuagacag

SEQ ID NO: 41862 - RNA, 20 nt, Artificial Sequence
  CIITA targeting sequence
aaaaauaaaaaaaaagaagu

SEQ ID NO: 41863 - RNA, 20 nt, Artificial Sequence
  CIITA targeting sequence
gucuaaaaauaaaaaaaaag

SEQ ID NO: 41864 - RNA, 20 nt, Artificial Sequence
  CIITA targeting sequence
cacuguugcccaggcuggcg

SEQ ID NO: 41865 - RNA, 20 nt, Artificial Sequence
  CIITA targeting sequence
cuguugcccaggcuggcgug

SEQ ID NO: 41866 - RNA, 20 nt, Artificial Sequence
  CIITA targeting sequence
caccacugcacgccagccug

SEQ ID NO: 41867 - RNA, 20 nt, Artificial Sequence
  CIITA targeting sequence
ggguucacugcaaccuccgc

SEQ ID NO: 41868 - RNA, 20 nt, Artificial Sequence
  CIITA targeting sequence
cugcaaccuccgccucuugg

SEQ ID NO: 41869 - RNA, 20 nt, Artificial Sequence
  CIITA targeting sequence
gccucuuggguucaagcgau

SEQ ID NO: 41870 - RNA, 20 nt, Artificial Sequence
  CIITA targeting sequence
uggguucaagcgauucuucu

SEQ ID NO: 41871 - RNA, 20 nt, Artificial Sequence
  CIITA targeting sequence
agcgauucuucugcuucagc

SEQ ID NO: 41872 - RNA, 20 nt, Artificial Sequence
  CIITA targeting sequence
cuugaacccaagaggcggag

SEQ ID NO: 41873 - RNA, 20 nt, Artificial Sequence
  CIITA targeting sequence
ucugcuucagccucccgagu

SEQ ID NO: 41874 - RNA, 20 nt, Artificial Sequence
  CIITA targeting sequence
gcuucagccucccgaguagc

SEQ ID NO: 41875 - RNA, 20 nt, Artificial Sequence
  CIITA targeting sequence
gccucccgaguagcugggac

SEQ ID NO: 41876 - RNA, 20 nt, Artificial Sequence
  CIITA targeting sequence
cgaguagcugggacuacagg

SEQ ID NO: 41877 - RNA, 20 nt, Artificial Sequence
  CIITA targeting sequence
ggaggcugaagcagaagaau

SEQ ID NO: 41878 - RNA, 20 nt, Artificial Sequence
  CIITA targeting sequence
cagcuacucgggaggcugaa

SEQ ID NO: 41879 - RNA, 20 nt, Artificial Sequence
  CIITA targeting sequence
ugucuggcuaauuuuucauu

SEQ ID NO: 41880 - RNA, 20 nt, Artificial Sequence
  CIITA targeting sequence
ggcuaauuuuucauuuuuag

SEQ ID NO: 41881 - RNA, 20 nt, Artificial Sequence
  CIITA targeting sequence
uuuuuaguagagacaggguu

SEQ ID NO: 41882 - RNA, 20 nt, Artificial Sequence
  CIITA targeting sequence
acuaaaaaugaaaaauuagc

SEQ ID NO: 41883 - RNA, 20 nt, Artificial Sequence
  CIITA targeting sequence
cuacuaaaaaugaaaaauua

SEQ ID NO: 41884 - RNA, 20 nt, Artificial Sequence
  CIITA targeting sequence
caaacucuugaccucaggug

SEQ ID NO: 41885 - RNA, 20 nt, Artificial Sequence
  CIITA targeting sequence
aacucuugaccucaggugau

SEQ ID NO: 41886 - RNA, 20 nt, Artificial Sequence
  CIITA targeting sequence
ugaccucaggugauccaccc

SEQ ID NO: 41887 - RNA, 20 nt, Artificial Sequence
  CIITA targeting sequence
agaguuugagaccagccugg

SEQ ID NO: 41888 - RNA, 20 nt, Artificial Sequence
  CIITA targeting sequence
ggugauccacccaccucagc

SEQ ID NO: 41889 - RNA, 20 nt, Artificial Sequence
  CIITA targeting sequence
ccugaggucaagaguuugag

SEQ ID NO: 41890 - RNA, 20 nt, Artificial Sequence
  CIITA targeting sequence
acccaccucagccucccaaa

SEQ ID NO: 41891 - RNA, 20 nt, Artificial Sequence
  CIITA targeting sequence
gccucccaaagugcugggau

SEQ ID NO: 41892 - RNA, 20 nt, Artificial Sequence
  CIITA targeting sequence
caaagugcugggauuacaag

SEQ ID NO: 41893 - RNA, 20 nt, Artificial Sequence
  CIITA targeting sequence
cagcacuuugggaggcugag

SEQ ID NO: 41894 - RNA, 20 nt, Artificial Sequence
  CIITA targeting sequence
cgcuuguaaucccagcacuu

SEQ ID NO: 41895 - RNA, 20 nt, Artificial Sequence
  CIITA targeting sequence
guggcccggugcaguggcuc

SEQ ID NO: 41896 - RNA, 20 nt, Artificial Sequence
  CIITA targeting sequence
cuguggcccggugcaguggc

SEQ ID NO: 41897 - RNA, 20 nt, Artificial Sequence
  CIITA targeting sequence
ccacccugcucuccgaccag

SEQ ID NO: 41898 - RNA, 20 nt, Artificial Sequence
  CIITA targeting sequence
acccugcucuccgaccagac

SEQ ID NO: 41899 - RNA, 20 nt, Artificial Sequence
  CIITA targeting sequence
ccgaccagacaccuugacag

SEQ ID NO: 41900 - RNA, 20 nt, Artificial Sequence
  CIITA targeting sequence
gaccagacaccuugacaggg

SEQ ID NO: 41901 - RNA, 20 nt, Artificial Sequence
  CIITA targeting sequence
gagagcaggguggagaagua

SEQ ID NO: 41902 - RNA, 20 nt, Artificial Sequence
  CIITA targeting sequence
ggucggagagcaggguggag

SEQ ID NO: 41903 - RNA, 20 nt, Artificial Sequence
  CIITA targeting sequence
aggugucuggucggagagca

SEQ ID NO: 41904 - RNA, 20 nt, Artificial Sequence
  CIITA targeting sequence
gaagacacugaugggcaacc

SEQ ID NO: 41905 - RNA, 20 nt, Artificial Sequence
  CIITA targeting sequence
gagugcccggugugcccugu

SEQ ID NO: 41906 - RNA, 20 nt, Artificial Sequence
  CIITA targeting sequence
ucugagugcccggugugccc

SEQ ID NO: 41907 - RNA, 20 nt, Artificial Sequence
  CIITA targeting sequence
gugucuucugagugcccggu

SEQ ID NO: 41908 - RNA, 20 nt, Artificial Sequence
  CIITA targeting sequence
ccagauugcaacaggcuggg

SEQ ID NO: 41909 - RNA, 20 nt, Artificial Sequence
  CIITA targeting sequence
ggggaauuagcaggcugggg

SEQ ID NO: 41910 - RNA, 20 nt, Artificial Sequence
  CIITA targeting sequence
guggcagcugcuuuugucua

SEQ ID NO: 41911 - RNA, 20 nt, Artificial Sequence
  CIITA targeting sequence
augggacucaaugcacugac

SEQ ID NO: 41912 - RNA, 20 nt, Artificial Sequence
  CIITA targeting sequence
cauagacaaaagcagcugcc

SEQ ID NO: 41913 - RNA, 20 nt, Artificial Sequence
  CIITA targeting sequence
augcacugacauuguuggcc

SEQ ID NO: 41914 - RNA, 20 nt, Artificial Sequence
  CIITA targeting sequence
gugcauugagucccauagac

SEQ ID NO: 41915 - RNA, 20 nt, Artificial Sequence
  CIITA targeting sequence
ggccaggccuagcuuuggcu

SEQ ID NO: 41916 - RNA, 20 nt, Artificial Sequence
  CIITA targeting sequence
cugcuaagggcuggugcauc

SEQ ID NO: 41917 - RNA, 20 nt, Artificial Sequence
  CIITA targeting sequence
cauuagcuguuucccugcua

SEQ ID NO: 41918 - RNA, 20 nt, Artificial Sequence
  CIITA targeting sequence
ccgccccauuagugucccau

SEQ ID NO: 41919 - RNA, 20 nt, Artificial Sequence
  CIITA targeting sequence
caccgccccauuaguguccc

SEQ ID NO: 41920 - RNA, 20 nt, Artificial Sequence
  CIITA targeting sequence
ccucucaccgccccauuagu

SEQ ID NO: 41921 - RNA, 20 nt, Artificial Sequence
  CIITA targeting sequence
guuccccucucaccgcccca

SEQ ID NO: 41922 - RNA, 20 nt, Artificial Sequence
  CIITA targeting sequence
agucuguuccccucucaccg

SEQ ID NO: 41923 - RNA, 20 nt, Artificial Sequence
  CIITA targeting sequence
uuuccugugucuuuuuucac

SEQ ID NO: 41924 - RNA, 20 nt, Artificial Sequence
  CIITA targeting sequence
ugugucuuuuuucacuacau

SEQ ID NO: 41925 - RNA, 20 nt, Artificial Sequence
  CIITA targeting sequence
uuuuucacuacauuauaaau

SEQ ID NO: 41926 - RNA, 20 nt, Artificial Sequence
  CIITA targeting sequence
cuacauuauaaaugucucuu

SEQ ID NO: 41927 - RNA, 20 nt, Artificial Sequence
  CIITA targeting sequence
cuuuaaugucacaggcaggu

SEQ ID NO: 41928 - RNA, 20 nt, Artificial Sequence
  CIITA targeting sequence
uuaaugucacaggcaggucc

SEQ ID NO: 41929 - RNA, 20 nt, Artificial Sequence
  CIITA targeting sequence
caggcagguccaggguuuga

SEQ ID NO: 41930 - RNA, 20 nt, Artificial Sequence
  CIITA targeting sequence
aggguuugaguucauacccu

SEQ ID NO: 41931 - RNA, 20 nt, Artificial Sequence
  CIITA targeting sequence
aacccuggaccugccuguga

SEQ ID NO: 41932 - RNA, 20 nt, Artificial Sequence
  CIITA targeting sequence
uacccuguuaccauuuuggg

SEQ ID NO: 41933 - RNA, 20 nt, Artificial Sequence
  CIITA targeting sequence
gguuaucuaauauguaacaa

SEQ ID NO: 41934 - RNA, 20 nt, Artificial Sequence
  CIITA targeting sequence
aauauguaacaagccacccc

SEQ ID NO: 41935 - RNA, 20 nt, Artificial Sequence
  CIITA targeting sequence
uaguggcuuaaaacaacacu

SEQ ID NO: 41936 - RNA, 20 nt, Artificial Sequence
  CIITA targeting sequence
cauuuauucugcucacauau

SEQ ID NO: 41937 - RNA, 20 nt, Artificial Sequence
  CIITA targeting sequence
gcucacauaucugucauuug

SEQ ID NO: 41938 - RNA, 20 nt, Artificial Sequence
  CIITA targeting sequence
cauaucugucauuugagcag

SEQ ID NO: 41939 - RNA, 20 nt, Artificial Sequence
  CIITA targeting sequence
gucauuugagcagggcucag

SEQ ID NO: 41940 - RNA, 20 nt, Artificial Sequence
  CIITA targeting sequence
uuugagcagggcucagcggg

SEQ ID NO: 41941 - RNA, 20 nt, Artificial Sequence
  CIITA targeting sequence
aaugacagauaugugagcag

SEQ ID NO: 41942 - RNA, 20 nt, Artificial Sequence
  CIITA targeting sequence
gcggggacagcuccuucugu

SEQ ID NO: 41943 - RNA, 20 nt, Artificial Sequence
  CIITA targeting sequence
ccgcugagcccugcucaaau

SEQ ID NO: 41944 - RNA, 20 nt, Artificial Sequence
  CIITA targeting sequence
uucuguccuacucuguguca

SEQ ID NO: 41945 - RNA, 20 nt, Artificial Sequence
  CIITA targeting sequence
guccuacucugugucaggug

SEQ ID NO: 41946 - RNA, 20 nt, Artificial Sequence
  CIITA targeting sequence
uacucugugucagguggggc

SEQ ID NO: 41947 - RNA, 20 nt, Artificial Sequence
  CIITA targeting sequence
gugucagguggggcagcuug

SEQ ID NO: 41948 - RNA, 20 nt, Artificial Sequence
  CIITA targeting sequence
gguggggcagcuugaggguu

SEQ ID NO: 41949 - RNA, 20 nt, Artificial Sequence
  CIITA targeting sequence
agcugccccaccugacacag

SEQ ID NO: 41950 - RNA, 20 nt, Artificial Sequence
  CIITA targeting sequence
ccugaagacucauucuucug

SEQ ID NO: 41951 - RNA, 20 nt, Artificial Sequence
  CIITA targeting sequence
ggugacaccagcccaacccu

SEQ ID NO: 41952 - RNA, 20 nt, Artificial Sequence
  CIITA targeting sequence
ucaggugacaccagcccaac

SEQ ID NO: 41953 - RNA, 20 nt, Artificial Sequence
  CIITA targeting sequence
uucuucuguacgucugacag

SEQ ID NO: 41954 - RNA, 20 nt, Artificial Sequence
  CIITA targeting sequence
ucuguacgucugacaggcaa

SEQ ID NO: 41955 - RNA, 20 nt, Artificial Sequence
  CIITA targeting sequence
guacgucugacaggcaaugc

SEQ ID NO: 41956 - RNA, 20 nt, Artificial Sequence
  CIITA targeting sequence
gacaggcaaugcuggcuguu

SEQ ID NO: 41957 - RNA, 20 nt, Artificial Sequence
  CIITA targeting sequence
gacguacagaagaaugaguc

SEQ ID NO: 41958 - RNA, 20 nt, Artificial Sequence
  CIITA targeting sequence
gugccacuacggaauaguug

SEQ ID NO: 41959 - RNA, 20 nt, Artificial Sequence
  CIITA targeting sequence
guaguggcacugaggccccc

SEQ ID NO: 41960 - RNA, 20 nt, Artificial Sequence
  CIITA targeting sequence
uagccaacuauuccguagug

SEQ ID NO: 41961 - RNA, 20 nt, Artificial Sequence
  CIITA targeting sequence
augugggcuaguugggcuuc

SEQ ID NO: 41962 - RNA, 20 nt, Artificial Sequence
  CIITA targeting sequence
ucauaguaugguggcugggu

SEQ ID NO: 41963 - RNA, 20 nt, Artificial Sequence
  CIITA targeting sequence
uaguaugguggcuggguugg

SEQ ID NO: 41964 - RNA, 20 nt, Artificial Sequence
  CIITA targeting sequence
aacccagccaccauacuaug

SEQ ID NO: 41965 - RNA, 20 nt, Artificial Sequence
  CIITA targeting sequence
caaaaagaaaggaggggaua

SEQ ID NO: 41966 - RNA, 20 nt, Artificial Sequence
  CIITA targeting sequence
uuuugggacacccuccaacc

SEQ ID NO: 41967 - RNA, 20 nt, Artificial Sequence
  CIITA targeting sequence
uuucuuuuugggacacccuc

SEQ ID NO: 41968 - RNA, 20 nt, Artificial Sequence
  CIITA targeting sequence
ccuccuuucuuuuugggaca

SEQ ID NO: 41969 - RNA, 20 nt, Artificial Sequence
  CIITA targeting sequence
auccccuccuuucuuuuugg

SEQ ID NO: 41970 - RNA, 20 nt, Artificial Sequence
  CIITA targeting sequence
cuauccccuccuuucuuuuu

SEQ ID NO: 41971 - RNA, 20 nt, Artificial Sequence
  CIITA targeting sequence
cucuauccccuccuuucuuu

SEQ ID NO: 41972 - RNA, 20 nt, Artificial Sequence
  CIITA targeting sequence
cucucuauccccuccuuucu

SEQ ID NO: 41973 - RNA, 20 nt, Artificial Sequence
  CIITA targeting sequence
uaaccuagccuuagaaguca

SEQ ID NO: 41974 - RNA, 20 nt, Artificial Sequence
  CIITA targeting sequence
aaggcuagguuaugaaaagu

SEQ ID NO: 41975 - RNA, 20 nt, Artificial Sequence
  CIITA targeting sequence
cacaguauuacuucugcuac

SEQ ID NO: 41976 - RNA, 20 nt, Artificial Sequence
  CIITA targeting sequence
gcuacauauauauguuuuaa

SEQ ID NO: 41977 - RNA, 20 nt, Artificial Sequence
  CIITA targeting sequence
uaaaacauauauauguagca

SEQ ID NO: 41978 - RNA, 20 nt, Artificial Sequence
  CIITA targeting sequence
cacucugucgcccagucugg

SEQ ID NO: 41979 - RNA, 20 nt, Artificial Sequence
  CIITA targeting sequence
cucugucgcccagucuggaa

SEQ ID NO: 41980 - RNA, 20 nt, Artificial Sequence
  CIITA targeting sequence
gucgcccagucuggaaugca

SEQ ID NO: 41981 - RNA, 20 nt, Artificial Sequence
  CIITA targeting sequence
cccagucuggaaugcagugg

SEQ ID NO: 41982 - RNA, 20 nt, Artificial Sequence
  CIITA targeting sequence
ggaaugcagugguaugauca

SEQ ID NO: 41983 - RNA, 20 nt, Artificial Sequence
  CIITA targeting sequence
agacugggcgacagagugag

SEQ ID NO: 41984 - RNA, 20 nt, Artificial Sequence
  CIITA targeting sequence
uaccacugcauuccagacug

SEQ ID NO: 41985 - RNA, 20 nt, Artificial Sequence
  CIITA targeting sequence
cggcucacugcagccucaac

SEQ ID NO: 41986 - RNA, 20 nt, Artificial Sequence
  CIITA targeting sequence
cugcagccucaaccuccugg

SEQ ID NO: 41987 - RNA, 20 nt, Artificial Sequence
  CIITA targeting sequence
accuccugggcuaagugauc

SEQ ID NO: 41988 - RNA, 20 nt, Artificial Sequence
  CIITA targeting sequence
ugggcuaagugauccuccca

SEQ ID NO: 41989 - RNA, 20 nt, Artificial Sequence
  CIITA targeting sequence
cuuagcccaggagguugagg

SEQ ID NO: 41990 - RNA, 20 nt, Artificial Sequence
  CIITA targeting sequence
ucccaccucagccucccgaa

SEQ ID NO: 41991 - RNA, 20 nt, Artificial Sequence
  CIITA targeting sequence
caccucagccucccgaauag

SEQ ID NO: 41992 - RNA, 20 nt, Artificial Sequence
  CIITA targeting sequence
gccucccgaauagcugggac

SEQ ID NO: 41993 - RNA, 20 nt, Artificial Sequence
  CIITA targeting sequence
cgaauagcugggacuacagg

SEQ ID NO: 41994 - RNA, 20 nt, Artificial Sequence
  CIITA targeting sequence
ggaggcugaggugggaggau

SEQ ID NO: 41995 - RNA, 20 nt, Artificial Sequence
  CIITA targeting sequence
cagcuauucgggaggcugag

SEQ ID NO: 41996 - RNA, 20 nt, Artificial Sequence
  CIITA targeting sequence
caccuguagucccagcuauu

SEQ ID NO: 41997 - RNA, 20 nt, Artificial Sequence
  CIITA targeting sequence
ccaagcccaguuaaucuuua

SEQ ID NO: 41998 - RNA, 20 nt, Artificial Sequence
  CIITA targeting sequence
uuaguuuuauuuuuguagag

SEQ ID NO: 41999 - RNA, 20 nt, Artificial Sequence
  CIITA targeting sequence
acaaaaauaaaacuaaagau

SEQ ID NO: 42000 - RNA, 20 nt, Artificial Sequence
  CIITA targeting sequence
cacuauguugcccaggcagg

SEQ ID NO: 42001 - RNA, 20 nt, Artificial Sequence
  CIITA targeting sequence
cuauguugcccaggcagguc

SEQ ID NO: 42002 - RNA, 20 nt, Artificial Sequence
  CIITA targeting sequence
ugaacuccuggccucaagug

SEQ ID NO: 42003 - RNA, 20 nt, Artificial Sequence
  CIITA targeting sequence
agaccugccugggcaacaua

SEQ ID NO: 42004 - RNA, 20 nt, Artificial Sequence
  CIITA targeting sequence
uggccucaagugauucuccu

SEQ ID NO: 42005 - RNA, 20 nt, Artificial Sequence
  CIITA targeting sequence
agugauucuccugccucagc

SEQ ID NO: 42006 - RNA, 20 nt, Artificial Sequence
  CIITA targeting sequence
cuugaggccaggaguucaag

SEQ ID NO: 42007 - RNA, 20 nt, Artificial Sequence
  CIITA targeting sequence
ccugccucagccucccaaag

SEQ ID NO: 42008 - RNA, 20 nt, Artificial Sequence
  CIITA targeting sequence
ugccucagccucccaaagug

SEQ ID NO: 42009 - RNA, 20 nt, Artificial Sequence
  CIITA targeting sequence
gccucccaaagugcugggau

SEQ ID NO: 42010 - RNA, 20 nt, Artificial Sequence
  CIITA targeting sequence
caaagugcugggauuacagg

SEQ ID NO: 42011 - RNA, 20 nt, Artificial Sequence
  CIITA targeting sequence
cagcacuuugggaggcugag

SEQ ID NO: 42012 - RNA, 20 nt, Artificial Sequence
  CIITA targeting sequence
caccuguaaucccagcacuu

SEQ ID NO: 42013 - RNA, 20 nt, Artificial Sequence
  CIITA targeting sequence
gccauauucuguuggccagu

SEQ ID NO: 42014 - RNA, 20 nt, Artificial Sequence
  CIITA targeting sequence
guuggccagugugacaagga

SEQ ID NO: 42015 - RNA, 20 nt, Artificial Sequence
  CIITA targeting sequence
cacuggccaacagaauaugg

SEQ ID NO: 42016 - RNA, 20 nt, Artificial Sequence
  CIITA targeting sequence
uugucacacuggccaacaga

SEQ ID NO: 42017 - RNA, 20 nt, Artificial Sequence
  CIITA targeting sequence
uacccacccuccuuucacca

SEQ ID NO: 42018 - RNA, 20 nt, Artificial Sequence
  CIITA targeting sequence
uuucaccacaugugcacaug

SEQ ID NO: 42019 - RNA, 20 nt, Artificial Sequence
  CIITA targeting sequence
ccacaugugcacaugcacgu

SEQ ID NO: 42020 - RNA, 20 nt, Artificial Sequence
  CIITA targeting sequence
ggugugugcacgcgugugug

SEQ ID NO: 42021 - RNA, 20 nt, Artificial Sequence
  CIITA targeting sequence
aguccucuuuucugagagga

SEQ ID NO: 42022 - RNA, 20 nt, Artificial Sequence
  CIITA targeting sequence
ucuuuucugagaggacuuuu

SEQ ID NO: 42023 - RNA, 20 nt, Artificial Sequence
  CIITA targeting sequence
uuucugagaggacuuuucuu

SEQ ID NO: 42024 - RNA, 20 nt, Artificial Sequence
  CIITA targeting sequence
gagaggacuuuucuuugugg

SEQ ID NO: 42025 - RNA, 20 nt, Artificial Sequence
  CIITA targeting sequence
gaaaagaggacuugagccaa

SEQ ID NO: 42026 - RNA, 20 nt, Artificial Sequence
  CIITA targeting sequence
cagaaaagaggacuugagcc

SEQ ID NO: 42027 - RNA, 20 nt, Artificial Sequence
  CIITA targeting sequence
ucucagaaaagaggacuuga

SEQ ID NO: 42028 - RNA, 20 nt, Artificial Sequence
  CIITA targeting sequence
uuguggcuuccuaaaauuca

SEQ ID NO: 42029 - RNA, 20 nt, Artificial Sequence
  CIITA targeting sequence
uaaaauucaguggaaaauua

SEQ ID NO: 42030 - RNA, 20 nt, Artificial Sequence
  CIITA targeting sequence
guggaaaauuaauuguuugg

SEQ ID NO: 42031 - RNA, 20 nt, Artificial Sequence
  CIITA targeting sequence
acugaauuuuaggaagccac

SEQ ID NO: 42032 - RNA, 20 nt, Artificial Sequence
  CIITA targeting sequence
ccaaacaauuaauuuuccac

SEQ ID NO: 42033 - RNA, 20 nt, Artificial Sequence
  CIITA targeting sequence
uccccaaacaauuaauuuuc

SEQ ID NO: 42034 - RNA, 20 nt, Artificial Sequence
  CIITA targeting sequence
cauccccaaacaauuaauuu

SEQ ID NO: 42035 - RNA, 20 nt, Artificial Sequence
  CIITA targeting sequence
accuuucucauccccaaaca

SEQ ID NO: 42036 - RNA, 20 nt, Artificial Sequence
  CIITA targeting sequence
ccuugguaagcuuuuggugc

SEQ ID NO: 42037 - RNA, 20 nt, Artificial Sequence
  CIITA targeting sequence
gccucugacacacagcucug

SEQ ID NO: 42038 - RNA, 20 nt, Artificial Sequence
  CIITA targeting sequence
gacacacagcucuguccugg

SEQ ID NO: 42039 - RNA, 20 nt, Artificial Sequence
  CIITA targeting sequence
gaggcagaggcaaacauucc

SEQ ID NO: 42040 - RNA, 20 nt, Artificial Sequence
  CIITA targeting sequence
guccugggagugagcugguu

SEQ ID NO: 42041 - RNA, 20 nt, Artificial Sequence
  CIITA targeting sequence
ugggagugagcugguuuuua

SEQ ID NO: 42042 - RNA, 20 nt, Artificial Sequence
  CIITA targeting sequence
caggacagagcuguguguca

SEQ ID NO: 42043 - RNA, 20 nt, Artificial Sequence
  CIITA targeting sequence
cucccaggacagagcugugu

SEQ ID NO: 42044 - RNA, 20 nt, Artificial Sequence
  CIITA targeting sequence
gcuaaaaaccagcucacucc

SEQ ID NO: 42045 - RNA, 20 nt, Artificial Sequence
  CIITA targeting sequence
ccgcuaaaaaccagcucacu

SEQ ID NO: 42046 - RNA, 20 nt, Artificial Sequence
  CIITA targeting sequence
gucuccgcuaaaaaccagcu

SEQ ID NO: 42047 - RNA, 20 nt, Artificial Sequence
  CIITA targeting sequence
caccuuggcugcagggaguc

SEQ ID NO: 42048 - RNA, 20 nt, Artificial Sequence
  CIITA targeting sequence
cugcagccaaggugggacuc

SEQ ID NO: 42049 - RNA, 20 nt, Artificial Sequence
  CIITA targeting sequence
gaaagggacuuggaagcucc

SEQ ID NO: 42050 - RNA, 20 nt, Artificial Sequence
  CIITA targeting sequence
gacucccugcagccaaggug

SEQ ID NO: 42051 - RNA, 20 nt, Artificial Sequence
  CIITA targeting sequence
cuuucggacucccugcagcc

SEQ ID NO: 42052 - RNA, 20 nt, Artificial Sequence
  CIITA targeting sequence
aagucccuuucggacucccu

SEQ ID NO: 42053 - RNA, 20 nt, Artificial Sequence
  CIITA targeting sequence
gcuuucuacccagcgagcug

SEQ ID NO: 42054 - RNA, 20 nt, Artificial Sequence
  CIITA targeting sequence
acccagcgagcugccggcac

SEQ ID NO: 42055 - RNA, 20 nt, Artificial Sequence
  CIITA targeting sequence
cuggguagaaagcggagcuu

SEQ ID NO: 42056 - RNA, 20 nt, Artificial Sequence
  CIITA targeting sequence
ugccggcagcucgcugggua

SEQ ID NO: 42057 - RNA, 20 nt, Artificial Sequence
  CIITA targeting sequence
cucgggcauagucugcucag

SEQ ID NO: 42058 - RNA, 20 nt, Artificial Sequence
  CIITA targeting sequence
ggcauagucugcucagaagc

SEQ ID NO: 42059 - RNA, 20 nt, Artificial Sequence
  CIITA targeting sequence
gcucagaagccccaauucaa

SEQ ID NO: 42060 - RNA, 20 nt, Artificial Sequence
  CIITA targeting sequence
gaagccccaauucaagacau

SEQ ID NO: 42061 - RNA, 20 nt, Artificial Sequence
  CIITA targeting sequence
gagcagacuaugcccgagug

SEQ ID NO: 42062 - RNA, 20 nt, Artificial Sequence
  CIITA targeting sequence
agacaucuuagcuuacuccu

SEQ ID NO: 42063 - RNA, 20 nt, Artificial Sequence
  CIITA targeting sequence
ugaauuggggcuucugagca

SEQ ID NO: 42064 - RNA, 20 nt, Artificial Sequence
  CIITA targeting sequence
uagcuuacuccugguggcag

SEQ ID NO: 42065 - RNA, 20 nt, Artificial Sequence
  CIITA targeting sequence
ugguggcagugggagcugcc

SEQ ID NO: 42066 - RNA, 20 nt, Artificial Sequence
  CIITA targeting sequence
cacugccaccaggaguaagc

SEQ ID NO: 42067 - RNA, 20 nt, Artificial Sequence
  CIITA targeting sequence
gcuccagcucaccagcccca

SEQ ID NO: 42068 - RNA, 20 nt, Artificial Sequence
  CIITA targeting sequence
agcucaccagccccagugcc

SEQ ID NO: 42069 - RNA, 20 nt, Artificial Sequence
  CIITA targeting sequence
ccagccccagugcccacagg

SEQ ID NO: 42070 - RNA, 20 nt, Artificial Sequence
  CIITA targeting sequence
ugugggcacuggggcuggug

SEQ ID NO: 42071 - RNA, 20 nt, Artificial Sequence
  CIITA targeting sequence
gucugauucccaagcucugc

SEQ ID NO: 42072 - RNA, 20 nt, Artificial Sequence
  CIITA targeting sequence
gauucccaagcucugcuccu

SEQ ID NO: 42073 - RNA, 20 nt, Artificial Sequence
  CIITA targeting sequence
gacugauccugugggcacug

SEQ ID NO: 42074 - RNA, 20 nt, Artificial Sequence
  CIITA targeting sequence
caagcucugcuccucucccc

SEQ ID NO: 42075 - RNA, 20 nt, Artificial Sequence
  CIITA targeting sequence
gcuccucuccccagcaagug

SEQ ID NO: 42076 - RNA, 20 nt, Artificial Sequence
  CIITA targeting sequence
ucuccccagcaagugagagc

SEQ ID NO: 42077 - RNA, 20 nt, Artificial Sequence
  CIITA targeting sequence
ccccagcaagugagagcugg

SEQ ID NO: 42078 - RNA, 20 nt, Artificial Sequence
  CIITA targeting sequence
ccagcaagugagagcugggu

SEQ ID NO: 42079 - RNA, 20 nt, Artificial Sequence
  CIITA targeting sequence
cuugcuggggagaggagcag

SEQ ID NO: 42080 - RNA, 20 nt, Artificial Sequence
  CIITA targeting sequence
cacuugcuggggagaggagc

SEQ ID NO: 42081 - RNA, 20 nt, Artificial Sequence
  CIITA targeting sequence
agagggucugaggaauccag

SEQ ID NO: 42082 - RNA, 20 nt, Artificial Sequence
  CIITA targeting sequence
ugacacccagcucucacuug

SEQ ID NO: 42083 - RNA, 20 nt, Artificial Sequence
  CIITA targeting sequence
gaggaauccagacccggcug

SEQ ID NO: 42084 - RNA, 20 nt, Artificial Sequence
  CIITA targeting sequence
gacccucuugacacccagcu

SEQ ID NO: 42085 - RNA, 20 nt, Artificial Sequence
  CIITA targeting sequence
ucagacccucuugacaccca

SEQ ID NO: 42086 - RNA, 20 nt, Artificial Sequence
  CIITA targeting sequence
agacccggcugcgugguuga

SEQ ID NO: 42087 - RNA, 20 nt, Artificial Sequence
  CIITA targeting sequence
ggauuccucagacccucuug

SEQ ID NO: 42088 - RNA, 20 nt, Artificial Sequence
  CIITA targeting sequence
accacgcagccgggucugga

SEQ ID NO: 42089 - RNA, 20 nt, Artificial Sequence
  CIITA targeting sequence
ucaaccacgcagccgggucu

SEQ ID NO: 42090 - RNA, 20 nt, Artificial Sequence
  CIITA targeting sequence
uugcagacaggcaagcaccu

SEQ ID NO: 42091 - RNA, 20 nt, Artificial Sequence
  CIITA targeting sequence
gcaaagaucaucaaccacgc

SEQ ID NO: 42092 - RNA, 20 nt, Artificial Sequence
  CIITA targeting sequence
ugccucgaacuggcugcaaa

SEQ ID NO: 42093 - RNA, 20 nt, Artificial Sequence
  CIITA targeting sequence
aacuggcugcaaaggguauc

SEQ ID NO: 42094 - RNA, 20 nt, Artificial Sequence
  CIITA targeting sequence
aggcaggaggugcuugccug

SEQ ID NO: 42095 - RNA, 20 nt, Artificial Sequence
  CIITA targeting sequence
ggugcugccauccagguuca

SEQ ID NO: 42096 - RNA, 20 nt, Artificial Sequence
  CIITA targeting sequence
agguucagcuuguaaauagc

SEQ ID NO: 42097 - RNA, 20 nt, Artificial Sequence
  CIITA targeting sequence
gcuuguaaauagcucaggug

SEQ ID NO: 42098 - RNA, 20 nt, Artificial Sequence
  CIITA targeting sequence
ggugucacccugcaagggau

SEQ ID NO: 42099 - RNA, 20 nt, Artificial Sequence
  CIITA targeting sequence
cccugcaagggaucccugca

SEQ ID NO: 42100 - RNA, 20 nt, Artificial Sequence
  CIITA targeting sequence
cuugcagggugacaccugag

SEQ ID NO: 42101 - RNA, 20 nt, Artificial Sequence
  CIITA targeting sequence
cugcacuugcagacucuaca

SEQ ID NO: 42102 - RNA, 20 nt, Artificial Sequence
  CIITA targeting sequence
gcaagugcagggaucccuug

SEQ ID NO: 42103 - RNA, 20 nt, Artificial Sequence
  CIITA targeting sequence
acagaggccaugggccuccu

SEQ ID NO: 42104 - RNA, 20 nt, Artificial Sequence
  CIITA targeting sequence
guagagucugcaagugcagg

SEQ ID NO: 42105 - RNA, 20 nt, Artificial Sequence
  CIITA targeting sequence
ugugugugcgccuacaggag

SEQ ID NO: 42106 - RNA, 20 nt, Artificial Sequence
  CIITA targeting sequence
uguaggcgcacacacaggag

SEQ ID NO: 42107 - RNA, 20 nt, Artificial Sequence
  CIITA targeting sequence
cuccuguaggcgcacacaca

SEQ ID NO: 42108 - RNA, 20 nt, Artificial Sequence
  CIITA targeting sequence
gaucauccacugugccaugu

SEQ ID NO: 42109 - RNA, 20 nt, Artificial Sequence
  CIITA targeting sequence
gagcacaccuuagugcucac

SEQ ID NO: 42110 - RNA, 20 nt, Artificial Sequence
  CIITA targeting sequence
uccacugugccaugugccag

SEQ ID NO: 42111 - RNA, 20 nt, Artificial Sequence
  CIITA targeting sequence
acugugccaugugccagguu

SEQ ID NO: 42112 - RNA, 20 nt, Artificial Sequence
  CIITA targeting sequence
gacccacugcuuuuggucug

SEQ ID NO: 42113 - RNA, 20 nt, Artificial Sequence
  CIITA targeting sequence
gaccaaaaaccuggcacaug

SEQ ID NO: 42114 - RNA, 20 nt, Artificial Sequence
  CIITA targeting sequence
gugugaugaugaaaugaggu

SEQ ID NO: 42115 - RNA, 20 nt, Artificial Sequence
  CIITA targeting sequence
cacagaccaaaagcaguggg

SEQ ID NO: 42116 - RNA, 20 nt, Artificial Sequence
  CIITA targeting sequence
ucacacagaccaaaagcagu

SEQ ID NO: 42117 - RNA, 20 nt, Artificial Sequence
  CIITA targeting sequence
ucaucacacagaccaaaagc

SEQ ID NO: 42118 - RNA, 20 nt, Artificial Sequence
  CIITA targeting sequence
uuucaucaucacacagacca

SEQ ID NO: 42119 - RNA, 20 nt, Artificial Sequence
  CIITA targeting sequence
gagccugcaguuauuaacac

SEQ ID NO: 42120 - RNA, 20 nt, Artificial Sequence
  CIITA targeting sequence
gaccucauuucaucaucaca

SEQ ID NO: 42121 - RNA, 20 nt, Artificial Sequence
  CIITA targeting sequence
uuaguguuaauaacugcagg

SEQ ID NO: 42122 - RNA, 20 nt, Artificial Sequence
  CIITA targeting sequence
uuaacaaaucguuaguguua

SEQ ID NO: 42123 - RNA, 20 nt, Artificial Sequence
  CIITA targeting sequence
aaaaaauuaaauaaaauaau

SEQ ID NO: 42124 - RNA, 20 nt, Artificial Sequence
  CIITA targeting sequence
caaaaaaauuaaauaaaaua

SEQ ID NO: 42125 - RNA, 20 nt, Artificial Sequence
  CIITA targeting sequence
gucucaaaaaaauuaaauaa

SEQ ID NO: 42126 - RNA, 20 nt, Artificial Sequence
  CIITA targeting sequence
cucuuauugcccacgcugga

SEQ ID NO: 42127 - RNA, 20 nt, Artificial Sequence
  CIITA targeting sequence
uauugcccacgcuggagugc

SEQ ID NO: 42128 - RNA, 20 nt, Artificial Sequence
  CIITA targeting sequence
agcgugggcaauaagaguga

SEQ ID NO: 42129 - RNA, 20 nt, Artificial Sequence
  CIITA targeting sequence
ugccacugcacuccagcgug

SEQ ID NO: 42130 - RNA, 20 nt, Artificial Sequence
  CIITA targeting sequence
cggcucacugcaaccucugc

SEQ ID NO: 42131 - RNA, 20 nt, Artificial Sequence
  CIITA targeting sequence
gcucacugcaaccucugccu

SEQ ID NO: 42132 - RNA, 20 nt, Artificial Sequence
  CIITA targeting sequence
cugcaaccucugccuccugg

SEQ ID NO: 42133 - RNA, 20 nt, Artificial Sequence
  CIITA targeting sequence
gccuccuggguucaagcaau

SEQ ID NO: 42134 - RNA, 20 nt, Artificial Sequence
  CIITA targeting sequence
uggguucaagcaauucuccc

SEQ ID NO: 42135 - RNA, 20 nt, Artificial Sequence
  CIITA targeting sequence
agcaauucucccaccucagc

SEQ ID NO: 42136 - RNA, 20 nt, Artificial Sequence
  CIITA targeting sequence
cccaccucagccucccaagu

SEQ ID NO: 42137 - RNA, 20 nt, Artificial Sequence
  CIITA targeting sequence
caccucagccucccaaguag

SEQ ID NO: 42138 - RNA, 20 nt, Artificial Sequence
  CIITA targeting sequence
gccucccaaguagcugggau

SEQ ID NO: 42139 - RNA, 20 nt, Artificial Sequence
  CIITA targeting sequence
caaguagcugggauuacagg

SEQ ID NO: 42140 - RNA, 20 nt, Artificial Sequence
  CIITA targeting sequence
cagcuacuugggaggcugag

SEQ ID NO: 42141 - RNA, 20 nt, Artificial Sequence
  CIITA targeting sequence
acuaaaaauacaaaaauuag

SEQ ID NO: 42142 - RNA, 20 nt, Artificial Sequence
  CIITA targeting sequence
cuacuaaaaauacaaaaauu

SEQ ID NO: 42143 - RNA, 20 nt, Artificial Sequence
  CIITA targeting sequence
aucucuacuaaaaauacaaa

SEQ ID NO: 42144 - RNA, 20 nt, Artificial Sequence
  CIITA targeting sequence
ccauguuggccaggcuggua

SEQ ID NO: 42145 - RNA, 20 nt, Artificial Sequence
  CIITA targeting sequence
gccugccuuggccucccaaa

SEQ ID NO: 42146 - RNA, 20 nt, Artificial Sequence
  CIITA targeting sequence
caaagugcugggauuacagg

SEQ ID NO: 42147 - RNA, 20 nt, Artificial Sequence
  CIITA targeting sequence
cagcacuuugggaggccaag

SEQ ID NO: 42148 - RNA, 20 nt, Artificial Sequence
  CIITA targeting sequence
ccccuguaaucccagcacuu

SEQ ID NO: 42149 - RNA, 20 nt, Artificial Sequence
  CIITA targeting sequence
uuaaauaaacaguaguggcc

SEQ ID NO: 42150 - RNA, 20 nt, Artificial Sequence
  CIITA targeting sequence
gcucauuaaauaaacaguag

SEQ ID NO: 42151 - RNA, 20 nt, Artificial Sequence
  CIITA targeting sequence
cagugcaagggaaauucaaa

SEQ ID NO: 42152 - RNA, 20 nt, Artificial Sequence
  CIITA targeting sequence
cuugcacugugauaagggcu

SEQ ID NO: 42153 - RNA, 20 nt, Artificial Sequence
  CIITA targeting sequence
aagcgcucagaaaguauuag

SEQ ID NO: 42154 - RNA, 20 nt, Artificial Sequence
  CIITA targeting sequence
gaaaguauuagcucaauaag

SEQ ID NO: 42155 - RNA, 20 nt, Artificial Sequence
  CIITA targeting sequence
gagcgcuuugaauuucccuu

SEQ ID NO: 42156 - RNA, 20 nt, Artificial Sequence
  CIITA targeting sequence
auaagugaugacugugugcc

SEQ ID NO: 42157 - RNA, 20 nt, Artificial Sequence
  CIITA targeting sequence
cuuauugagcuaauacuuuc

SEQ ID NO: 42158 - RNA, 20 nt, Artificial Sequence
  CIITA targeting sequence
ucacuuauugagcuaauacu

SEQ ID NO: 42159 - RNA, 20 nt, Artificial Sequence
  CIITA targeting sequence
ggcacacagucaucacuuau

SEQ ID NO: 42160 - RNA, 20 nt, Artificial Sequence
  CIITA targeting sequence
uacucaagagggauaagagu

SEQ ID NO: 42161 - RNA, 20 nt, Artificial Sequence
  CIITA targeting sequence
agagggauaagagucuaggg

SEQ ID NO: 42162 - RNA, 20 nt, Artificial Sequence
  CIITA targeting sequence
ugaguaggaguuuagcacag

SEQ ID NO: 42163 - RNA, 20 nt, Artificial Sequence
  CIITA targeting sequence
cucuugaguaggaguuuagc

SEQ ID NO: 42164 - RNA, 20 nt, Artificial Sequence
  CIITA targeting sequence
uaucccucuugaguaggagu

SEQ ID NO: 42165 - RNA, 20 nt, Artificial Sequence
  CIITA targeting sequence
aggggcaaguggcagagacu

SEQ ID NO: 42166 - RNA, 20 nt, Artificial Sequence
  CIITA targeting sequence
gccacuugccccuagacucu

SEQ ID NO: 42167 - RNA, 20 nt, Artificial Sequence
  CIITA targeting sequence
cugccacuugccccuagacu

SEQ ID NO: 42168 - RNA, 20 nt, Artificial Sequence
  CIITA targeting sequence
agaacgagauugccugggcu

SEQ ID NO: 42169 - RNA, 20 nt, Artificial Sequence
  CIITA targeting sequence
agagucucugccacuugccc

SEQ ID NO: 42170 - RNA, 20 nt, Artificial Sequence
  CIITA targeting sequence
uucuagagucucugccacuu

SEQ ID NO: 42171 - RNA, 20 nt, Artificial Sequence
  CIITA targeting sequence
cguucuagagucucugccac

SEQ ID NO: 42172 - RNA, 20 nt, Artificial Sequence
  CIITA targeting sequence
acgcccaccucaccacuuac

SEQ ID NO: 42173 - RNA, 20 nt, Artificial Sequence
  CIITA targeting sequence
ccacuuacuuaugcaagcua

SEQ ID NO: 42174 - RNA, 20 nt, Artificial Sequence
  CIITA targeting sequence
cugugccucagucuccucau

SEQ ID NO: 42175 - RNA, 20 nt, Artificial Sequence
  CIITA targeting sequence
gugccucagucuccucauuu

SEQ ID NO: 42176 - RNA, 20 nt, Artificial Sequence
  CIITA targeting sequence
gucuccucauuuguaaaaug

SEQ ID NO: 42177 - RNA, 20 nt, Artificial Sequence
  CIITA targeting sequence
ccucauuuguaaaaugggca

SEQ ID NO: 42178 - RNA, 20 nt, Artificial Sequence
  CIITA targeting sequence
ucauuuguaaaaugggcaua

SEQ ID NO: 42179 - RNA, 20 nt, Artificial Sequence
  CIITA targeting sequence
uuuguaaaaugggcauaacc

SEQ ID NO: 42180 - RNA, 20 nt, Artificial Sequence
  CIITA targeting sequence
uuauaggauuaugugaaggu

SEQ ID NO: 42181 - RNA, 20 nt, Artificial Sequence
  CIITA targeting sequence
uauaaagaaggugcuguggu

SEQ ID NO: 42182 - RNA, 20 nt, Artificial Sequence
  CIITA targeting sequence
cauaauccuauaaagaaggu

SEQ ID NO: 42183 - RNA, 20 nt, Artificial Sequence
  CIITA targeting sequence
ccacaccuucacauaauccu

SEQ ID NO: 42184 - RNA, 20 nt, Artificial Sequence
  CIITA targeting sequence
uaacguauuagcucaccaca

SEQ ID NO: 42185 - RNA, 20 nt, Artificial Sequence
  CIITA targeting sequence
aauucuuaacguauuagcuc

SEQ ID NO: 42186 - RNA, 20 nt, Artificial Sequence
  CIITA targeting sequence
auaacauguuggcugucauu

SEQ ID NO: 42187 - RNA, 20 nt, Artificial Sequence
  CIITA targeting sequence
uuauuacauauaucuguguu

SEQ ID NO: 42188 - RNA, 20 nt, Artificial Sequence
  CIITA targeting sequence
guguuucauucuugccucug

SEQ ID NO: 42189 - RNA, 20 nt, Artificial Sequence
  CIITA targeting sequence
uucuugccucuggcuggaau

SEQ ID NO: 42190 - RNA, 20 nt, Artificial Sequence
  CIITA targeting sequence
ugccucuggcuggaauguuc

SEQ ID NO: 42191 - RNA, 20 nt, Artificial Sequence
  CIITA targeting sequence
ggcuggaauguucuucccag

SEQ ID NO: 42192 - RNA, 20 nt, Artificial Sequence
  CIITA targeting sequence
agccagaggcaagaaugaaa

SEQ ID NO: 42193 - RNA, 20 nt, Artificial Sequence
  CIITA targeting sequence
ucccagcucuccauauggcu

SEQ ID NO: 42194 - RNA, 20 nt, Artificial Sequence
  CIITA targeting sequence
cagcucuccauauggcugau

SEQ ID NO: 42195 - RNA, 20 nt, Artificial Sequence
  CIITA targeting sequence
ccauauggcugauuucucau

SEQ ID NO: 42196 - RNA, 20 nt, Artificial Sequence
  CIITA targeting sequence
auauggcugauuucucaucc

SEQ ID NO: 42197 - RNA, 20 nt, Artificial Sequence
  CIITA targeting sequence
gccauauggagagcugggaa

SEQ ID NO: 42198 - RNA, 20 nt, Artificial Sequence
  CIITA targeting sequence
cauccuucgggacuugcccc

SEQ ID NO: 42199 - RNA, 20 nt, Artificial Sequence
  CIITA targeting sequence
uccuucgggacuugccccau

SEQ ID NO: 42200 - RNA, 20 nt, Artificial Sequence
  CIITA targeting sequence
uucgggacuugccccauucu

SEQ ID NO: 42201 - RNA, 20 nt, Artificial Sequence
  CIITA targeting sequence
ggacuugccccauucuccaa

SEQ ID NO: 42202 - RNA, 20 nt, Artificial Sequence
  CIITA targeting sequence
cgaaggaugagaaaucagcc

SEQ ID NO: 42203 - RNA, 20 nt, Artificial Sequence
  CIITA targeting sequence
ccaaccccaucacuaguuuu

SEQ ID NO: 42204 - RNA, 20 nt, Artificial Sequence
  CIITA targeting sequence
aaccccaucacuaguuuuau

SEQ ID NO: 42205 - RNA, 20 nt, Artificial Sequence
  CIITA targeting sequence
cuaguuuuaucuuuuucacu

SEQ ID NO: 42206 - RNA, 20 nt, Artificial Sequence
  CIITA targeting sequence
uuuucacuuauuuaugcagu

SEQ ID NO: 42207 - RNA, 20 nt, Artificial Sequence
  CIITA targeting sequence
cuuauuuaugcagucugcuc

SEQ ID NO: 42208 - RNA, 20 nt, Artificial Sequence
  CIITA targeting sequence
gcucuuguccuaggacauga

SEQ ID NO: 42209 - RNA, 20 nt, Artificial Sequence
  CIITA targeting sequence
uguccuaggacaugagcucc

SEQ ID NO: 42210 - RNA, 20 nt, Artificial Sequence
  CIITA targeting sequence
uaggacaugagcuccaggag

SEQ ID NO: 42211 - RNA, 20 nt, Artificial Sequence
  CIITA targeting sequence
uaggacaagagcagacugca

SEQ ID NO: 42212 - RNA, 20 nt, Artificial Sequence
  CIITA targeting sequence
uguccuaggacaagagcaga

SEQ ID NO: 42213 - RNA, 20 nt, Artificial Sequence
  CIITA targeting sequence
aggagggcgggaaacaucuc

SEQ ID NO: 42214 - RNA, 20 nt, Artificial Sequence
  CIITA targeting sequence
uggagcucauguccuaggac

SEQ ID NO: 42215 - RNA, 20 nt, Artificial Sequence
  CIITA targeting sequence
cgcccuccuggagcucaugu

SEQ ID NO: 42216 - RNA, 20 nt, Artificial Sequence
  CIITA targeting sequence
cgcuuuguacacugcugugc

SEQ ID NO: 42217 - RNA, 20 nt, Artificial Sequence
  CIITA targeting sequence
cuuuguacacugcugugccc

SEQ ID NO: 42218 - RNA, 20 nt, Artificial Sequence
  CIITA targeting sequence
guacccagcaaggcgccugu

SEQ ID NO: 42219 - RNA, 20 nt, Artificial Sequence
  CIITA targeting sequence
auaacauaaaaugaacaaau

SEQ ID NO: 42220 - RNA, 20 nt, Artificial Sequence
  CIITA targeting sequence
uuuuauguuauugagcaccu

SEQ ID NO: 42221 - RNA, 20 nt, Artificial Sequence
  CIITA targeting sequence
ucaccuaacgguuucauuca

SEQ ID NO: 42222 - RNA, 20 nt, Artificial Sequence
  CIITA targeting sequence
ccuaacgguuucauucauuc

SEQ ID NO: 42223 - RNA, 20 nt, Artificial Sequence
  CIITA targeting sequence
uucauucugcaaauacauac

SEQ ID NO: 42224 - RNA, 20 nt, Artificial Sequence
  CIITA targeting sequence
uucugcaaauacauacugac

SEQ ID NO: 42225 - RNA, 20 nt, Artificial Sequence
  CIITA targeting sequence
gcaaauacauacugacagca

SEQ ID NO: 42226 - RNA, 20 nt, Artificial Sequence
  CIITA targeting sequence
guauguauuugcagaaugaa

SEQ ID NO: 42227 - RNA, 20 nt, Artificial Sequence
  CIITA targeting sequence
ugaauaagauguuccugccc

SEQ ID NO: 42228 - RNA, 20 nt, Artificial Sequence
  CIITA targeting sequence
ugacugugcugucaguaugu

SEQ ID NO: 42229 - RNA, 20 nt, Artificial Sequence
  CIITA targeting sequence
uauucaugacugugcuguca

SEQ ID NO: 42230 - RNA, 20 nt, Artificial Sequence
  CIITA targeting sequence
ugcccuggugagucuuauau

SEQ ID NO: 42231 - RNA, 20 nt, Artificial Sequence
  CIITA targeting sequence
ccagggcaggaacaucuuau

SEQ ID NO: 42232 - RNA, 20 nt, Artificial Sequence
  CIITA targeting sequence
uauauuuuagcaaauuaaaa

SEQ ID NO: 42233 - RNA, 20 nt, Artificial Sequence
  CIITA targeting sequence
uuggacagggcugccaggug

SEQ ID NO: 42234 - RNA, 20 nt, Artificial Sequence
  CIITA targeting sequence
aaagaguuuuuuuaauuugc

SEQ ID NO: 42235 - RNA, 20 nt, Artificial Sequence
  CIITA targeting sequence
ccuggcagcccuguccaaag

SEQ ID NO: 42236 - RNA, 20 nt, Artificial Sequence
  CIITA targeting sequence
guacacugcacaaaggcacc

SEQ ID NO: 42237 - RNA, 20 nt, Artificial Sequence
  CIITA targeting sequence
caggugccuuugugcagugu

SEQ ID NO: 42238 - RNA, 20 nt, Artificial Sequence
  CIITA targeting sequence
cccuugucccaggugccuuu

SEQ ID NO: 42239 - RNA, 20 nt, Artificial Sequence
  CIITA targeting sequence
ggguucugcuugccaaacug

SEQ ID NO: 42240 - RNA, 20 nt, Artificial Sequence
  CIITA targeting sequence
gcuugccaaacugggagucc

SEQ ID NO: 42241 - RNA, 20 nt, Artificial Sequence
  CIITA targeting sequence
caguuuggcaagcagaaccc

SEQ ID NO: 42242 - RNA, 20 nt, Artificial Sequence
  CIITA targeting sequence
ugguguggagccuuuuaacc

SEQ ID NO: 42243 - RNA, 20 nt, Artificial Sequence
  CIITA targeting sequence
acaccaggacucccaguuug

SEQ ID NO: 42244 - RNA, 20 nt, Artificial Sequence
  CIITA targeting sequence
ggguuaaaaggcuccacacc

SEQ ID NO: 42245 - RNA, 20 nt, Artificial Sequence
  CIITA targeting sequence
uuucguaguuaacgcacagu

SEQ ID NO: 42246 - RNA, 20 nt, Artificial Sequence
  CIITA targeting sequence
uaguuaacgcacagucaucg

SEQ ID NO: 42247 - RNA, 20 nt, Artificial Sequence
  CIITA targeting sequence
ucguaagauguggauaaauu

SEQ ID NO: 42248 - RNA, 20 nt, Artificial Sequence
  CIITA targeting sequence
uaagauguggauaaauuacu

SEQ ID NO: 42249 - RNA, 20 nt, Artificial Sequence
  CIITA targeting sequence
uacgaugacugugcguuaac

SEQ ID NO: 42250 - RNA, 20 nt, Artificial Sequence
  CIITA targeting sequence
acaucuuacgaugacugugc

SEQ ID NO: 42251 - RNA, 20 nt, Artificial Sequence
  CIITA targeting sequence
ccgugucacagaucuaagug

SEQ ID NO: 42252 - RNA, 20 nt, Artificial Sequence
  CIITA targeting sequence
gugucacagaucuaagugau

SEQ ID NO: 42253 - RNA, 20 nt, Artificial Sequence
  CIITA targeting sequence
cagaucuaagugauacuuau

SEQ ID NO: 42254 - RNA, 20 nt, Artificial Sequence
  CIITA targeting sequence
gugacacggagacaguaauu

SEQ ID NO: 42255 - RNA, 20 nt, Artificial Sequence
  CIITA targeting sequence
aagugauacuuauagucaca

SEQ ID NO: 42256 - RNA, 20 nt, Artificial Sequence
  CIITA targeting sequence
cuuagaucugugacacggag

SEQ ID NO: 42257 - RNA, 20 nt, Artificial Sequence
  CIITA targeting sequence
cacuccuauaaaggaaugga

SEQ ID NO: 42258 - RNA, 20 nt, Artificial Sequence
  CIITA targeting sequence
uauaaaggaauggacuucug

SEQ ID NO: 42259 - RNA, 20 nt, Artificial Sequence
  CIITA targeting sequence
uuuauaggagugugacuaua

SEQ ID NO: 42260 - RNA, 20 nt, Artificial Sequence
  CIITA targeting sequence
auuccuuuauaggaguguga

SEQ ID NO: 42261 - RNA, 20 nt, Artificial Sequence
  CIITA targeting sequence
gacuucuuuggaggaccucu

SEQ ID NO: 42262 - RNA, 20 nt, Artificial Sequence
  CIITA targeting sequence
gaaguccauuccuuuauagg

SEQ ID NO: 42263 - RNA, 20 nt, Artificial Sequence
  CIITA targeting sequence
uuggaggaccucucugcagg

SEQ ID NO: 42264 - RNA, 20 nt, Artificial Sequence
  CIITA targeting sequence
aaagaagucagaaguccauu

SEQ ID NO: 42265 - RNA, 20 nt, Artificial Sequence
  CIITA targeting sequence
uccaaagaagucagaagucc

SEQ ID NO: 42266 - RNA, 20 nt, Artificial Sequence
  CIITA targeting sequence
cugcagggacaggcacagug

SEQ ID NO: 42267 - RNA, 20 nt, Artificial Sequence
  CIITA targeting sequence
gcagggacaggcacagugug

SEQ ID NO: 42268 - RNA, 20 nt, Artificial Sequence
  CIITA targeting sequence
cugcagagagguccuccaaa

SEQ ID NO: 42269 - RNA, 20 nt, Artificial Sequence
  CIITA targeting sequence
ggcacacugugccugucccu

SEQ ID NO: 42270 - RNA, 20 nt, Artificial Sequence
  CIITA targeting sequence
ggggcacuuccggcacacug

SEQ ID NO: 42271 - RNA, 20 nt, Artificial Sequence
  CIITA targeting sequence
ggugguaaagcgcugcucgg

SEQ ID NO: 42272 - RNA, 20 nt, Artificial Sequence
  CIITA targeting sequence
gaggaaucagggcaugauag

SEQ ID NO: 42273 - RNA, 20 nt, Artificial Sequence
  CIITA targeting sequence
gagcagcgcuuuaccaccug

SEQ ID NO: 42274 - RNA, 20 nt, Artificial Sequence
  CIITA targeting sequence
uccgagcagcgcuuuaccac

SEQ ID NO: 42275 - RNA, 20 nt, Artificial Sequence
  CIITA targeting sequence
gggcaugauagugcaauucc

SEQ ID NO: 42276 - RNA, 20 nt, Artificial Sequence
  CIITA targeting sequence
ugcccugauuccuccgagca

SEQ ID NO: 42277 - RNA, 20 nt, Artificial Sequence
  CIITA targeting sequence
auguccaguggauuguaagu

SEQ ID NO: 42278 - RNA, 20 nt, Artificial Sequence
  CIITA targeting sequence
aguggauuguaaguccacgc

SEQ ID NO: 42279 - RNA, 20 nt, Artificial Sequence
  CIITA targeting sequence
acuggacauggaauugcacu

SEQ ID NO: 42280 - RNA, 20 nt, Artificial Sequence
  CIITA targeting sequence
acgcaccuuccaaaugguca

SEQ ID NO: 42281 - RNA, 20 nt, Artificial Sequence
  CIITA targeting sequence
aaauggucacucuuccucgc

SEQ ID NO: 42282 - RNA, 20 nt, Artificial Sequence
  CIITA targeting sequence
cucuuccucgcaggccucuc

SEQ ID NO: 42283 - RNA, 20 nt, Artificial Sequence
  CIITA targeting sequence
uccucgcaggccucucucug

SEQ ID NO: 42284 - RNA, 20 nt, Artificial Sequence
  CIITA targeting sequence
ucgcaggccucucucugcau

SEQ ID NO: 42285 - RNA, 20 nt, Artificial Sequence
  CIITA targeting sequence
caggccucucucugcauaca

SEQ ID NO: 42286 - RNA, 20 nt, Artificial Sequence
  CIITA targeting sequence
cucugcauacaaaugucucc

SEQ ID NO: 42287 - RNA, 20 nt, Artificial Sequence
  CIITA targeting sequence
cugcauacaaaugucucccu

SEQ ID NO: 42288 - RNA, 20 nt, Artificial Sequence
  CIITA targeting sequence
gcauacaaaugucucccucc

SEQ ID NO: 42289 - RNA, 20 nt, Artificial Sequence
  CIITA targeting sequence
cccuccugacgcucaccuuu

SEQ ID NO: 42290 - RNA, 20 nt, Artificial Sequence
  CIITA targeting sequence
cuccugacgcucaccuuuuu

SEQ ID NO: 42291 - RNA, 20 nt, Artificial Sequence
  CIITA targeting sequence
ugacgcucaccuuuuucccu

SEQ ID NO: 42292 - RNA, 20 nt, Artificial Sequence
  CIITA targeting sequence
ggagggagacauuuguaugc

SEQ ID NO: 42293 - RNA, 20 nt, Artificial Sequence
  CIITA targeting sequence
ccuuuuucccuggggcucuc

SEQ ID NO: 42294 - RNA, 20 nt, Artificial Sequence
  CIITA targeting sequence
cuggggcucucaaaugucuu

SEQ ID NO: 42295 - RNA, 20 nt, Artificial Sequence
  CIITA targeting sequence
caaaugucuucuuuucagau

SEQ ID NO: 42296 - RNA, 20 nt, Artificial Sequence
  CIITA targeting sequence
aaugucuucuuuucagauuu

SEQ ID NO: 42297 - RNA, 20 nt, Artificial Sequence
  CIITA targeting sequence
ucuuuucagauuucguagcu

SEQ ID NO: 42298 - RNA, 20 nt, Artificial Sequence
  CIITA targeting sequence
uuucagauuucguagcuuuu

SEQ ID NO: 42299 - RNA, 20 nt, Artificial Sequence
  CIITA targeting sequence
gauuucguagcuuuucuuuc

SEQ ID NO: 42300 - RNA, 20 nt, Artificial Sequence
  CIITA targeting sequence
gaaaagaagacauuugagag

SEQ ID NO: 42301 - RNA, 20 nt, Artificial Sequence
  CIITA targeting sequence
uagcuuuucuuucuuuagca

SEQ ID NO: 42302 - RNA, 20 nt, Artificial Sequence
  CIITA targeting sequence
uucuuuagcaucacuugagg

SEQ ID NO: 42303 - RNA, 20 nt, Artificial Sequence
  CIITA targeting sequence
uuagcaucacuugagggcaa

SEQ ID NO: 42304 - RNA, 20 nt, Artificial Sequence
  CIITA targeting sequence
cuugagggcaaguggugcuc

SEQ ID NO: 42305 - RNA, 20 nt, Artificial Sequence
  CIITA targeting sequence
agugaugcuaaagaaagaaa

SEQ ID NO: 42306 - RNA, 20 nt, Artificial Sequence
  CIITA targeting sequence
aacugucuccccccagaguu

SEQ ID NO: 42307 - RNA, 20 nt, Artificial Sequence
  CIITA targeting sequence
ccccccagaguucugccgcc

SEQ ID NO: 42308 - RNA, 20 nt, Artificial Sequence
  CIITA targeting sequence
ccccagaguucugccgccug

SEQ ID NO: 42309 - RNA, 20 nt, Artificial Sequence
  CIITA targeting sequence
ggggggagacaguuggagca

SEQ ID NO: 42310 - RNA, 20 nt, Artificial Sequence
  CIITA targeting sequence
gccgccuguacucucccaca

SEQ ID NO: 42311 - RNA, 20 nt, Artificial Sequence
  CIITA targeting sequence
cccacaccucagucuccucg

SEQ ID NO: 42312 - RNA, 20 nt, Artificial Sequence
  CIITA targeting sequence
cacaccucagucuccucgcc

SEQ ID NO: 42313 - RNA, 20 nt, Artificial Sequence
  CIITA targeting sequence
gucuccucgccuguagaaag

SEQ ID NO: 42314 - RNA, 20 nt, Artificial Sequence
  CIITA targeting sequence
ccucgccuguagaaaggggu

SEQ ID NO: 42315 - RNA, 20 nt, Artificial Sequence
  CIITA targeting sequence
ucgccuguagaaagggguca

SEQ ID NO: 42316 - RNA, 20 nt, Artificial Sequence
  CIITA targeting sequence
ccuguagaaaggggucaauc

SEQ ID NO: 42317 - RNA, 20 nt, Artificial Sequence
  CIITA targeting sequence
acaggcgaggagacugaggu

SEQ ID NO: 42318 - RNA, 20 nt, Artificial Sequence
  CIITA targeting sequence
aucguuugaacccugcuuca

SEQ ID NO: 42319 - RNA, 20 nt, Artificial Sequence
  CIITA targeting sequence
uuugaacccugcuucacuug

SEQ ID NO: 42320 - RNA, 20 nt, Artificial Sequence
  CIITA targeting sequence
aacgauugaccccuuucuac

SEQ ID NO: 42321 - RNA, 20 nt, Artificial Sequence
  CIITA targeting sequence
cuugguguguaugugaaggu

SEQ ID NO: 42322 - RNA, 20 nt, Artificial Sequence
  CIITA targeting sequence
cauacacaccaagugaagca

SEQ ID NO: 42323 - RNA, 20 nt, Artificial Sequence
  CIITA targeting sequence
aagcaccuucacauacacac

SEQ ID NO: 42324 - RNA, 20 nt, Artificial Sequence
  CIITA targeting sequence
agugcucugcaaacuggaga

SEQ ID NO: 42325 - RNA, 20 nt, Artificial Sequence
  CIITA targeting sequence
gcaaacuggagagaauuacu

SEQ ID NO: 42326 - RNA, 20 nt, Artificial Sequence
  CIITA targeting sequence
aguuugcagagcacuugauu

SEQ ID NO: 42327 - RNA, 20 nt, Artificial Sequence
  CIITA targeting sequence
ccaguuugcagagcacuuga

SEQ ID NO: 42328 - RNA, 20 nt, Artificial Sequence
  CIITA targeting sequence
cuccaguuugcagagcacuu

SEQ ID NO: 42329 - RNA, 20 nt, Artificial Sequence
  CIITA targeting sequence
gugaaacuacaagcucccaa

SEQ ID NO: 42330 - RNA, 20 nt, Artificial Sequence
  CIITA targeting sequence
cggaauacaagcaguaauuc

SEQ ID NO: 42331 - RNA, 20 nt, Artificial Sequence
  CIITA targeting sequence
caauuccacucauuuaaucc

SEQ ID NO: 42332 - RNA, 20 nt, Artificial Sequence
  CIITA targeting sequence
acucauuuaaucccucucuu

SEQ ID NO: 42333 - RNA, 20 nt, Artificial Sequence
  CIITA targeting sequence
uuuaaucccucucuugcucu

SEQ ID NO: 42334 - RNA, 20 nt, Artificial Sequence
  CIITA targeting sequence
cucucuugcucuguugccca

SEQ ID NO: 42335 - RNA, 20 nt, Artificial Sequence
  CIITA targeting sequence
cuugcucuguugcccaggcu

SEQ ID NO: 42336 - RNA, 20 nt, Artificial Sequence
  CIITA targeting sequence
ugcucuguugcccaggcugg

SEQ ID NO: 42337 - RNA, 20 nt, Artificial Sequence
  CIITA targeting sequence
guugcccaggcuggaaugca

SEQ ID NO: 42338 - RNA, 20 nt, Artificial Sequence
  CIITA targeting sequence
agccugggcaacagagcaag

SEQ ID NO: 42339 - RNA, 20 nt, Artificial Sequence
  CIITA targeting sequence
ugccacugcauuccagccug

SEQ ID NO: 42340 - RNA, 20 nt, Artificial Sequence
  CIITA targeting sequence
caacucacugcaaccucugc

SEQ ID NO: 42341 - RNA, 20 nt, Artificial Sequence
  CIITA targeting sequence
acucacugcaaccucugccu

SEQ ID NO: 42342 - RNA, 20 nt, Artificial Sequence
  CIITA targeting sequence
cugcaaccucugccucccug

SEQ ID NO: 42343 - RNA, 20 nt, Artificial Sequence
  CIITA targeting sequence
gccucccugguuucaagcaa

SEQ ID NO: 42344 - RNA, 20 nt, Artificial Sequence
  CIITA targeting sequence
cugguuucaagcaauucucc

SEQ ID NO: 42345 - RNA, 20 nt, Artificial Sequence
  CIITA targeting sequence
agcaauucuccugccucagc

SEQ ID NO: 42346 - RNA, 20 nt, Artificial Sequence
  CIITA targeting sequence
ccugccucagccucccgagu

SEQ ID NO: 42347 - RNA, 20 nt, Artificial Sequence
  CIITA targeting sequence
ugccucagccucccgaguag

SEQ ID NO: 42348 - RNA, 20 nt, Artificial Sequence
  CIITA targeting sequence
gccucccgaguagcugggac

SEQ ID NO: 42349 - RNA, 20 nt, Artificial Sequence
  CIITA targeting sequence
cgaguagcugggacuauaag

SEQ ID NO: 42350 - RNA, 20 nt, Artificial Sequence
  CIITA targeting sequence
ggaggcugaggcaggagaau

SEQ ID NO: 42351 - RNA, 20 nt, Artificial Sequence
  CIITA targeting sequence
cagcuacucgggaggcugag

SEQ ID NO: 42352 - RNA, 20 nt, Artificial Sequence
  CIITA targeting sequence
acuaaaaauacaaaaaaauu

SEQ ID NO: 42353 - RNA, 20 nt, Artificial Sequence
  CIITA targeting sequence
cuacuaaaaauacaaaaaaa

SEQ ID NO: 42354 - RNA, 20 nt, Artificial Sequence
  CIITA targeting sequence
ccgugguggccaggcugguc

SEQ ID NO: 42355 - RNA, 20 nt, Artificial Sequence
  CIITA targeting sequence
cgaacuccuaaccucaagug

SEQ ID NO: 42356 - RNA, 20 nt, Artificial Sequence
  CIITA targeting sequence
aacuccuaaccucaagugau

SEQ ID NO: 42357 - RNA, 20 nt, Artificial Sequence
  CIITA targeting sequence
agaccagccuggccaccacg

SEQ ID NO: 42358 - RNA, 20 nt, Artificial Sequence
  CIITA targeting sequence
uaaccucaagugaucugccc

SEQ ID NO: 42359 - RNA, 20 nt, Artificial Sequence
  CIITA targeting sequence
agugaucugcccgccucggc

SEQ ID NO: 42360 - RNA, 20 nt, Artificial Sequence
  CIITA targeting sequence
cuugagguuaggaguucgag

SEQ ID NO: 42361 - RNA, 20 nt, Artificial Sequence
  CIITA targeting sequence
gcccgccucggccuuccaaa

SEQ ID NO: 42362 - RNA, 20 nt, Artificial Sequence
  CIITA targeting sequence
gccuuccaaagugcugggau

SEQ ID NO: 42363 - RNA, 20 nt, Artificial Sequence
  CIITA targeting sequence
aaagugcugggauuacaggc

SEQ ID NO: 42364 - RNA, 20 nt, Artificial Sequence
  CIITA targeting sequence
cagcacuuuggaaggccgag

SEQ ID NO: 42365 - RNA, 20 nt, Artificial Sequence
  CIITA targeting sequence
ugccuguaaucccagcacuu

SEQ ID NO: 42366 - RNA, 20 nt, Artificial Sequence
  CIITA targeting sequence
ccccuaucuuuaaugaaggu

SEQ ID NO: 42367 - RNA, 20 nt, Artificial Sequence
  CIITA targeting sequence
uuaaugaaggucuaccaugu

SEQ ID NO: 42368 - RNA, 20 nt, Artificial Sequence
  CIITA targeting sequence
uuaaagauaggggggaaggg

SEQ ID NO: 42369 - RNA, 20 nt, Artificial Sequence
  CIITA targeting sequence
accaugugccugacacaggg

SEQ ID NO: 42370 - RNA, 20 nt, Artificial Sequence
  CIITA targeting sequence
ggcacaugguagaccuucau

SEQ ID NO: 42371 - RNA, 20 nt, Artificial Sequence
  CIITA targeting sequence
ccugugucaggcacauggua

SEQ ID NO: 42372 - RNA, 20 nt, Artificial Sequence
  CIITA targeting sequence
augggauucaggccugguuu

SEQ ID NO: 42373 - RNA, 20 nt, Artificial Sequence
  CIITA targeting sequence
cauagaagugggggugggua

SEQ ID NO: 42374 - RNA, 20 nt, Artificial Sequence
  CIITA targeting sequence
ggccugguuuccagcuuggc

SEQ ID NO: 42375 - RNA, 20 nt, Artificial Sequence
  CIITA targeting sequence
agcuuggccuucaggcuuuu

SEQ ID NO: 42376 - RNA, 20 nt, Artificial Sequence
  CIITA targeting sequence
ggcuuuucccaccacacccc

SEQ ID NO: 42377 - RNA, 20 nt, Artificial Sequence
  CIITA targeting sequence
caccacaccccaaaugcugu

SEQ ID NO: 42378 - RNA, 20 nt, Artificial Sequence
  CIITA targeting sequence
cuggcuuguggaguggggca

SEQ ID NO: 42379 - RNA, 20 nt, Artificial Sequence
  CIITA targeting sequence
acaagccagggacagcauuu

SEQ ID NO: 42380 - RNA, 20 nt, Artificial Sequence
  CIITA targeting sequence
caggcuggcccccugcccca

SEQ ID NO: 42381 - RNA, 20 nt, Artificial Sequence
  CIITA targeting sequence
cgccagcccgacuggggcag

SEQ ID NO: 42382 - RNA, 20 nt, Artificial Sequence
  CIITA targeting sequence
ggcuggcgugaaagucccag

SEQ ID NO: 42383 - RNA, 20 nt, Artificial Sequence
  CIITA targeting sequence
gccccagucgggcuggcgug

SEQ ID NO: 42384 - RNA, 20 nt, Artificial Sequence
  CIITA targeting sequence
cucaaccccacuggaucuuc

SEQ ID NO: 42385 - RNA, 20 nt, Artificial Sequence
  CIITA targeting sequence
caaccccacuggaucuucug

SEQ ID NO: 42386 - RNA, 20 nt, Artificial Sequence
  CIITA targeting sequence
accccacuggaucuucugcu

SEQ ID NO: 42387 - RNA, 20 nt, Artificial Sequence
  CIITA targeting sequence
agugggguugagagagucug

SEQ ID NO: 42388 - RNA, 20 nt, Artificial Sequence
  CIITA targeting sequence
ucugcuguuugucagccaca

SEQ ID NO: 42389 - RNA, 20 nt, Artificial Sequence
  CIITA targeting sequence
gcuguuugucagccacaagg

SEQ ID NO: 42390 - RNA, 20 nt, Artificial Sequence
  CIITA targeting sequence
gccacaagguucugccuaga

SEQ ID NO: 42391 - RNA, 20 nt, Artificial Sequence
  CIITA targeting sequence
gccuagaacuccuuucccga

SEQ ID NO: 42392 - RNA, 20 nt, Artificial Sequence
  CIITA targeting sequence
aggcagaaccuuguggcuga

SEQ ID NO: 42393 - RNA, 20 nt, Artificial Sequence
  CIITA targeting sequence
uuucccgaaucucaaaguua

SEQ ID NO: 42394 - RNA, 20 nt, Artificial Sequence
  CIITA targeting sequence
cgaaucucaaaguuaaaaaa

SEQ ID NO: 42395 - RNA, 20 nt, Artificial Sequence
  CIITA targeting sequence
ggaaaggaguucuaggcaga

SEQ ID NO: 42396 - RNA, 20 nt, Artificial Sequence
  CIITA targeting sequence
caaaguuaaaaaaaaaggca

SEQ ID NO: 42397 - RNA, 20 nt, Artificial Sequence
  CIITA targeting sequence
aaguuaaaaaaaaaggcagg

SEQ ID NO: 42398 - RNA, 20 nt, Artificial Sequence
  CIITA targeting sequence
aaccccuggggcccugccuu

SEQ ID NO: 42399 - RNA, 20 nt, Artificial Sequence
  CIITA targeting sequence
aaagaaguaagccuccuaag

SEQ ID NO: 42400 - RNA, 20 nt, Artificial Sequence
  CIITA targeting sequence
uuggauuaaaaaaaaaugua

SEQ ID NO: 42401 - RNA, 20 nt, Artificial Sequence
  CIITA targeting sequence
uaaguauugcuuagacaggu

SEQ ID NO: 42402 - RNA, 20 nt, Artificial Sequence
  CIITA targeting sequence
aagcaauacuuaggaggcuu

SEQ ID NO: 42403 - RNA, 20 nt, Artificial Sequence
  CIITA targeting sequence
gaauuaaguaggcacaacac

SEQ ID NO: 42404 - RNA, 20 nt, Artificial Sequence
  CIITA targeting sequence
gauaaaccugucuaagcaau

SEQ ID NO: 42405 - RNA, 20 nt, Artificial Sequence
  CIITA targeting sequence
uacuuucagaaaagcauuuc

SEQ ID NO: 42406 - RNA, 20 nt, Artificial Sequence
  CIITA targeting sequence
gaaaagcauuuccagccagg

SEQ ID NO: 42407 - RNA, 20 nt, Artificial Sequence
  CIITA targeting sequence
gaaaguaugaguguugugcc

SEQ ID NO: 42408 - RNA, 20 nt, Artificial Sequence
  CIITA targeting sequence
agccaggggaguaacguggc

SEQ ID NO: 42409 - RNA, 20 nt, Artificial Sequence
  CIITA targeting sequence
ccuggcuggaaaugcuuuuc

SEQ ID NO: 42410 - RNA, 20 nt, Artificial Sequence
  CIITA targeting sequence
ccagcaugaugucuguuuug

SEQ ID NO: 42411 - RNA, 20 nt, Artificial Sequence
  CIITA targeting sequence
ugcuggugagugccacguua

SEQ ID NO: 42412 - RNA, 20 nt, Artificial Sequence
  CIITA targeting sequence
guuuugccaacuugcugaag

SEQ ID NO: 42413 - RNA, 20 nt, Artificial Sequence
  CIITA targeting sequence
gcaaguuggcaaaacagaca

SEQ ID NO: 42414 - RNA, 20 nt, Artificial Sequence
  CIITA targeting sequence
ucagcaaguuggcaaaacag

SEQ ID NO: 42415 - RNA, 20 nt, Artificial Sequence
  CIITA targeting sequence
uucuucagcaaguuggcaaa

SEQ ID NO: 42416 - RNA, 20 nt, Artificial Sequence
  CIITA targeting sequence
gguuacucguucuucagcaa

SEQ ID NO: 42417 - RNA, 20 nt, Artificial Sequence
  CIITA targeting sequence
uuucagguuacucguucuuc

SEQ ID NO: 42418 - RNA, 20 nt, Artificial Sequence
  CIITA targeting sequence
uucauuucagguuacucguu

SEQ ID NO: 42419 - RNA, 20 nt, Artificial Sequence
  CIITA targeting sequence
cuccuucauuucagguuacu

SEQ ID NO: 42420 - RNA, 20 nt, Artificial Sequence
  CIITA targeting sequence
cgcuccuucauuucagguua

SEQ ID NO: 42421 - RNA, 20 nt, Artificial Sequence
  CIITA targeting sequence
cacccucagccccccaacag

SEQ ID NO: 42422 - RNA, 20 nt, Artificial Sequence
  CIITA targeting sequence
gccccccaacagcuuccuca

SEQ ID NO: 42423 - RNA, 20 nt, Artificial Sequence
  CIITA targeting sequence
ucagcuucuuuuucuucuga

SEQ ID NO: 42424 - RNA, 20 nt, Artificial Sequence
  CIITA targeting sequence
gcuucuuuuucuucugaguc

SEQ ID NO: 42425 - RNA, 20 nt, Artificial Sequence
  CIITA targeting sequence
uuuucuucugagucaccccu

SEQ ID NO: 42426 - RNA, 20 nt, Artificial Sequence
  CIITA targeting sequence
ucugagucaccccugaaaca

SEQ ID NO: 42427 - RNA, 20 nt, Artificial Sequence
  CIITA targeting sequence
gagucaccccugaaacaguc

SEQ ID NO: 42428 - RNA, 20 nt, Artificial Sequence
  CIITA targeting sequence
gaagaaaaagaagcugagga

SEQ ID NO: 42429 - RNA, 20 nt, Artificial Sequence
  CIITA targeting sequence
ccccugaaacagucgcugca

SEQ ID NO: 42430 - RNA, 20 nt, Artificial Sequence
  CIITA targeting sequence
ggggugacucagaagaaaaa

SEQ ID NO: 42431 - RNA, 20 nt, Artificial Sequence
  CIITA targeting sequence
cugcaucuaagaccagccuc

SEQ ID NO: 42432 - RNA, 20 nt, Artificial Sequence
  CIITA targeting sequence
aagaccagccucgggcuaaa

SEQ ID NO: 42433 - RNA, 20 nt, Artificial Sequence
  CIITA targeting sequence
uagaugcagcgacuguuuca

SEQ ID NO: 42434 - RNA, 20 nt, Artificial Sequence
  CIITA targeting sequence
ggcuaaacccagcuggccug

SEQ ID NO: 42435 - RNA, 20 nt, Artificial Sequence
  CIITA targeting sequence
ggccagcuggguuuagcccg

SEQ ID NO: 42436 - RNA, 20 nt, Artificial Sequence
  CIITA targeting sequence
acucacaucaaacggagcug

SEQ ID NO: 42437 - RNA, 20 nt, Artificial Sequence
  CIITA targeting sequence
caucaaacggagcugggagu

SEQ ID NO: 42438 - RNA, 20 nt, Artificial Sequence
  CIITA targeting sequence
aacggagcugggagucgcuu

SEQ ID NO: 42439 - RNA, 20 nt, Artificial Sequence
  CIITA targeting sequence
guuugaugugaguugagccu

SEQ ID NO: 42440 - RNA, 20 nt, Artificial Sequence
  CIITA targeting sequence
cagcuccguuugaugugagu

SEQ ID NO: 42441 - RNA, 20 nt, Artificial Sequence
  CIITA targeting sequence
cuuuugcguguguccgcagu

SEQ ID NO: 42442 - RNA, 20 nt, Artificial Sequence
  CIITA targeting sequence
gcaguuugaaguguccucuc

SEQ ID NO: 42443 - RNA, 20 nt, Artificial Sequence
  CIITA targeting sequence
aacugcggacacacgcaaaa

SEQ ID NO: 42444 - RNA, 20 nt, Artificial Sequence
  CIITA targeting sequence
ucuccgaaggugaagugggg

SEQ ID NO: 42445 - RNA, 20 nt, Artificial Sequence
  CIITA targeting sequence
ccgaaggugaagugggggaa

SEQ ID NO: 42446 - RNA, 20 nt, Artificial Sequence
  CIITA targeting sequence
gaaggugaagugggggaagc

SEQ ID NO: 42447 - RNA, 20 nt, Artificial Sequence
  CIITA targeting sequence
gagaggacacuucaaacugc

SEQ ID NO: 42448 - RNA, 20 nt, Artificial Sequence
  CIITA targeting sequence
ccuucggagaggacacuuca

SEQ ID NO: 42449 - RNA, 20 nt, Artificial Sequence
  CIITA targeting sequence
cccacuucaccuucggagag

SEQ ID NO: 42450 - RNA, 20 nt, Artificial Sequence
  CIITA targeting sequence
gggaugaagugcagggaggc

SEQ ID NO: 42451 - RNA, 20 nt, Artificial Sequence
  CIITA targeting sequence
cggagcgcaccugcuucccc

SEQ ID NO: 42452 - RNA, 20 nt, Artificial Sequence
  CIITA targeting sequence
ucccggagcgcaccugcuuc

SEQ ID NO: 42453 - RNA, 20 nt, Artificial Sequence
  CIITA targeting sequence
cugcacuucaucccggagcg

SEQ ID NO: 42454 - RNA, 20 nt, Artificial Sequence
  CIITA targeting sequence
ggcuggguuccuguaaacau

SEQ ID NO: 42455 - RNA, 20 nt, Artificial Sequence
  CIITA targeting sequence
uguaaacauccaucgcagcu

SEQ ID NO: 42456 - RNA, 20 nt, Artificial Sequence
  CIITA targeting sequence
aucgcagcugcaaauaauca

SEQ ID NO: 42457 - RNA, 20 nt, Artificial Sequence
  CIITA targeting sequence
cagcugcaaauaaucagaag

SEQ ID NO: 42458 - RNA, 20 nt, Artificial Sequence
  CIITA targeting sequence
gaagccaaggccaggccauc

SEQ ID NO: 42459 - RNA, 20 nt, Artificial Sequence
  CIITA targeting sequence
gauuauuugcagcugcgaug

SEQ ID NO: 42460 - RNA, 20 nt, Artificial Sequence
  CIITA targeting sequence
auuugacacugcaggcagau

SEQ ID NO: 42461 - RNA, 20 nt, Artificial Sequence
  CIITA targeting sequence
auggccuggccuuggcuucu

SEQ ID NO: 42462 - RNA, 20 nt, Artificial Sequence
  CIITA targeting sequence
aaucgauggccuggccuugg

SEQ ID NO: 42463 - RNA, 20 nt, Artificial Sequence
  CIITA targeting sequence
gccugcagugucaaaucgau

SEQ ID NO: 42464 - RNA, 20 nt, Artificial Sequence
  CIITA targeting sequence
ucugccugcagugucaaauc

SEQ ID NO: 42465 - RNA, 20 nt, Artificial Sequence
  CIITA targeting sequence
ugggaugccucuugcguucc

SEQ ID NO: 42466 - RNA, 20 nt, Artificial Sequence
  CIITA targeting sequence
caagaccucaucugccugca

SEQ ID NO: 42467 - RNA, 20 nt, Artificial Sequence
  CIITA targeting sequence
ugcguucccccuucuguggg

SEQ ID NO: 42468 - RNA, 20 nt, Artificial Sequence
  CIITA targeting sequence
cccuucugugggagcaggug

SEQ ID NO: 42469 - RNA, 20 nt, Artificial Sequence
  CIITA targeting sequence
gugggagcaggugccuuccc

SEQ ID NO: 42470 - RNA, 20 nt, Artificial Sequence
  CIITA targeting sequence
cacagaagggggaacgcaag

SEQ ID NO: 42471 - RNA, 20 nt, Artificial Sequence
  CIITA targeting sequence
caaccucagcacucaguccc

SEQ ID NO: 42472 - RNA, 20 nt, Artificial Sequence
  CIITA targeting sequence
gcacucagucccaaucucuc

SEQ ID NO: 42473 - RNA, 20 nt, Artificial Sequence
  CIITA targeting sequence
gucccaaucucucuuccacu

SEQ ID NO: 42474 - RNA, 20 nt, Artificial Sequence
  CIITA targeting sequence
caaucucucuuccacucucc

SEQ ID NO: 42475 - RNA, 20 nt, Artificial Sequence
  CIITA targeting sequence
cucuuccacucuccuggguu

SEQ ID NO: 42476 - RNA, 20 nt, Artificial Sequence
  CIITA targeting sequence
cuuccacucuccuggguuca

SEQ ID NO: 42477 - RNA, 20 nt, Artificial Sequence
  CIITA targeting sequence
uccacucuccuggguucaaa

SEQ ID NO: 42478 - RNA, 20 nt, Artificial Sequence
  CIITA targeting sequence
acucuccuggguucaaacag

SEQ ID NO: 42479 - RNA, 20 nt, Artificial Sequence
  CIITA targeting sequence
ccuggguucaaacaggaacc

SEQ ID NO: 42480 - RNA, 20 nt, Artificial Sequence
  CIITA targeting sequence
uggguucaaacaggaaccuc

SEQ ID NO: 42481 - RNA, 20 nt, Artificial Sequence
  CIITA targeting sequence
aacaggaaccucucuguugg

SEQ ID NO: 42482 - RNA, 20 nt, Artificial Sequence
  CIITA targeting sequence
uguuugaacccaggagagug

SEQ ID NO: 42483 - RNA, 20 nt, Artificial Sequence
  CIITA targeting sequence
cuguuggcacgaagcuuuug

SEQ ID NO: 42484 - RNA, 20 nt, Artificial Sequence
  CIITA targeting sequence
guuggcacgaagcuuuugag

SEQ ID NO: 42485 - RNA, 20 nt, Artificial Sequence
  CIITA targeting sequence
ugccaacagagagguuccug

SEQ ID NO: 42486 - RNA, 20 nt, Artificial Sequence
  CIITA targeting sequence
aaagcuucgugccaacagag

SEQ ID NO: 42487 - RNA, 20 nt, Artificial Sequence
  CIITA targeting sequence
ccucaaaagcuucgugccaa

SEQ ID NO: 42488 - RNA, 20 nt, Artificial Sequence
  CIITA targeting sequence
aacaagaaggaaaaaggggg

SEQ ID NO: 42489 - RNA, 20 nt, Artificial Sequence
  CIITA targeting sequence
uguuagaccugcuccccuca

SEQ ID NO: 42490 - RNA, 20 nt, Artificial Sequence
  CIITA targeting sequence
uucuuguuagaccugcuccc

SEQ ID NO: 42491 - RNA, 20 nt, Artificial Sequence
  CIITA targeting sequence
gugcuaauaaccccccuuuu

SEQ ID NO: 42492 - RNA, 20 nt, Artificial Sequence
  CIITA targeting sequence
ccagccaaccugguggcagg

SEQ ID NO: 42493 - RNA, 20 nt, Artificial Sequence
  CIITA targeting sequence
cuguccccagccaaccuggu

SEQ ID NO: 42494 - RNA, 20 nt, Artificial Sequence
  CIITA targeting sequence
accaggcucgggaggcuugg

SEQ ID NO: 42495 - RNA, 20 nt, Artificial Sequence
  CIITA targeting sequence
ggaggcuugggguggggcag

SEQ ID NO: 42496 - RNA, 20 nt, Artificial Sequence
  CIITA targeting sequence
cgagccugguggauuggucc

SEQ ID NO: 42497 - RNA, 20 nt, Artificial Sequence
  CIITA targeting sequence
cugccccaccccaagccucc

SEQ ID NO: 42498 - RNA, 20 nt, Artificial Sequence
  CIITA targeting sequence
uccuccaucccucaaauuua

SEQ ID NO: 42499 - RNA, 20 nt, Artificial Sequence
  CIITA targeting sequence
uccaucccucaaauuuaggg

SEQ ID NO: 42500 - RNA, 20 nt, Artificial Sequence
  CIITA targeting sequence
aucccucaaauuuagggaac

SEQ ID NO: 42501 - RNA, 20 nt, Artificial Sequence
  CIITA targeting sequence
cucaaauuuagggaaccacu

SEQ ID NO: 42502 - RNA, 20 nt, Artificial Sequence
  CIITA targeting sequence
aauuuagggaaccacuggga

SEQ ID NO: 42503 - RNA, 20 nt, Artificial Sequence
  CIITA targeting sequence
cuaaauuugagggauggagg

SEQ ID NO: 42504 - RNA, 20 nt, Artificial Sequence
  CIITA targeting sequence
cagugguucccuaaauuuga

SEQ ID NO: 42505 - RNA, 20 nt, Artificial Sequence
  CIITA targeting sequence
ggggcucccagugguucccu

SEQ ID NO: 42506 - RNA, 20 nt, Artificial Sequence
  CIITA targeting sequence
ggcugaaaaugucuuucugc

SEQ ID NO: 42507 - RNA, 20 nt, Artificial Sequence
  CIITA targeting sequence
gccugagucuggggcuccca

SEQ ID NO: 42508 - RNA, 20 nt, Artificial Sequence
  CIITA targeting sequence
uucugcaaauauaaaacucu

SEQ ID NO: 42509 - RNA, 20 nt, Artificial Sequence
  CIITA targeting sequence
gcaaauauaaaacucuuuuu

SEQ ID NO: 42510 - RNA, 20 nt, Artificial Sequence
  CIITA targeting sequence
uuuuaaugaauuugccuaau

SEQ ID NO: 42511 - RNA, 20 nt, Artificial Sequence
  CIITA targeting sequence
uuaaaaagaguuuuauauuu

SEQ ID NO: 42512 - RNA, 20 nt, Artificial Sequence
  CIITA targeting sequence
cagagacccugggcuggaga

SEQ ID NO: 42513 - RNA, 20 nt, Artificial Sequence
  CIITA targeting sequence
gagacccugggcuggagaac

SEQ ID NO: 42514 - RNA, 20 nt, Artificial Sequence
  CIITA targeting sequence
gagaaauuaggcaaauucau

SEQ ID NO: 42515 - RNA, 20 nt, Artificial Sequence
  CIITA targeting sequence
cugagaaauuaggcaaauuc

SEQ ID NO: 42516 - RNA, 20 nt, Artificial Sequence
  CIITA targeting sequence
agcccagggucucugagaaa

SEQ ID NO: 42517 - RNA, 20 nt, Artificial Sequence
  CIITA targeting sequence
ccagcccagggucucugaga

SEQ ID NO: 42518 - RNA, 20 nt, Artificial Sequence
  CIITA targeting sequence
cacgggagaggaaggacugu

SEQ ID NO: 42519 - RNA, 20 nt, Artificial Sequence
  CIITA targeting sequence
cgugugacauugcacugguu

SEQ ID NO: 42520 - RNA, 20 nt, Artificial Sequence
  CIITA targeting sequence
cccgugugacauugcacugg

SEQ ID NO: 42521 - RNA, 20 nt, Artificial Sequence
  CIITA targeting sequence
ucucccgugugacauugcac

SEQ ID NO: 42522 - RNA, 20 nt, Artificial Sequence
  CIITA targeting sequence
uuccucucccgugugacauu

SEQ ID NO: 42523 - RNA, 20 nt, Artificial Sequence
  CIITA targeting sequence
uguuuauugggagggaggag

SEQ ID NO: 42524 - RNA, 20 nt, Artificial Sequence
  CIITA targeting sequence
caauaaacaggacaguccuu

SEQ ID NO: 42525 - RNA, 20 nt, Artificial Sequence
  CIITA targeting sequence
cucccaauaaacaggacagu

SEQ ID NO: 42526 - RNA, 20 nt, Artificial Sequence
  CIITA targeting sequence
ucccucccaauaaacaggac

SEQ ID NO: 42527 - RNA, 20 nt, Artificial Sequence
  CIITA targeting sequence
cccuccucccucccaauaaa

SEQ ID NO: 42528 - RNA, 20 nt, Artificial Sequence
  CIITA targeting sequence
ggagucacccagggucugag

SEQ ID NO: 42529 - RNA, 20 nt, Artificial Sequence
  CIITA targeting sequence
ugagcaggcugcaccagcau

SEQ ID NO: 42530 - RNA, 20 nt, Artificial Sequence
  CIITA targeting sequence
cccagggucugagggcugac

SEQ ID NO: 42531 - RNA, 20 nt, Artificial Sequence
  CIITA targeting sequence
gagggcugacuugcagcucu

SEQ ID NO: 42532 - RNA, 20 nt, Artificial Sequence
  CIITA targeting sequence
gacccugggugacuccugag

SEQ ID NO: 42533 - RNA, 20 nt, Artificial Sequence
  CIITA targeting sequence
gcccucagacccugggugac

SEQ ID NO: 42534 - RNA, 20 nt, Artificial Sequence
  CIITA targeting sequence
gggccagcugagccagcgcu

SEQ ID NO: 42535 - RNA, 20 nt, Artificial Sequence
  CIITA targeting sequence
gcuggcccagagcugcaagu

SEQ ID NO: 42536 - RNA, 20 nt, Artificial Sequence
  CIITA targeting sequence
accuugcccggaaaaaugcu

SEQ ID NO: 42537 - RNA, 20 nt, Artificial Sequence
  CIITA targeting sequence
gggcaagguggaagguguug

SEQ ID NO: 42538 - RNA, 20 nt, Artificial Sequence
  CIITA targeting sequence
uguagguugcaaagcauuuu

SEQ ID NO: 42539 - RNA, 20 nt, Artificial Sequence
  CIITA targeting sequence
gcagccccacuuggcucuuu

SEQ ID NO: 42540 - RNA, 20 nt, Artificial Sequence
  CIITA targeting sequence
uucucccaggaugcagcauc

SEQ ID NO: 42541 - RNA, 20 nt, Artificial Sequence
  CIITA targeting sequence
cccaggaugcagcaucaucu

SEQ ID NO: 42542 - RNA, 20 nt, Artificial Sequence
  CIITA targeting sequence
caggaugcagcaucaucucc

SEQ ID NO: 42543 - RNA, 20 nt, Artificial Sequence
  CIITA targeting sequence
ugggagaaagagccaagugg

SEQ ID NO: 42544 - RNA, 20 nt, Artificial Sequence
  CIITA targeting sequence
ucuccauggccuggcccccu

SEQ ID NO: 42545 - RNA, 20 nt, Artificial Sequence
  CIITA targeting sequence
ccauggccuggcccccuggc

SEQ ID NO: 42546 - RNA, 20 nt, Artificial Sequence
  CIITA targeting sequence
auggccuggcccccuggcac

SEQ ID NO: 42547 - RNA, 20 nt, Artificial Sequence
  CIITA targeting sequence
ccguuucccacugccuucuc

SEQ ID NO: 42548 - RNA, 20 nt, Artificial Sequence
  CIITA targeting sequence
cacugccuucucugugugcc

SEQ ID NO: 42549 - RNA, 20 nt, Artificial Sequence
  CIITA targeting sequence
cugugugccuagccgggugc

SEQ ID NO: 42550 - RNA, 20 nt, Artificial Sequence
  CIITA targeting sequence
gugugccuagccgggugcca

SEQ ID NO: 42551 - RNA, 20 nt, Artificial Sequence
  CIITA targeting sequence
cuguagcaccucguguuccc

SEQ ID NO: 42552 - RNA, 20 nt, Artificial Sequence
  CIITA targeting sequence
guagcaccucguguucccau

SEQ ID NO: 42553 - RNA, 20 nt, Artificial Sequence
  CIITA targeting sequence
uguucccaugcccaaccccu

SEQ ID NO: 42554 - RNA, 20 nt, Artificial Sequence
  CIITA targeting sequence
caugcccaaccccucugcag

SEQ ID NO: 42555 - RNA, 20 nt, Artificial Sequence
  CIITA targeting sequence
gcagcccccucaagcccugc

SEQ ID NO: 42556 - RNA, 20 nt, Artificial Sequence
  CIITA targeting sequence
agcccugcucugauuccaag

SEQ ID NO: 42557 - RNA, 20 nt, Artificial Sequence
  CIITA targeting sequence
gauuccaagccucaucuccc

SEQ ID NO: 42558 - RNA, 20 nt, Artificial Sequence
  CIITA targeting sequence
gagcagggcuugagggggcu

SEQ ID NO: 42559 - RNA, 20 nt, Artificial Sequence
  CIITA targeting sequence
aagccucaucucccagcuca

SEQ ID NO: 42560 - RNA, 20 nt, Artificial Sequence
  CIITA targeting sequence
ucucccagcucacuauccuu

SEQ ID NO: 42561 - RNA, 20 nt, Artificial Sequence
  CIITA targeting sequence
cccagcucacuauccuuucc

SEQ ID NO: 42562 - RNA, 20 nt, Artificial Sequence
  CIITA targeting sequence
cagcucacuauccuuuccgc

SEQ ID NO: 42563 - RNA, 20 nt, Artificial Sequence
  CIITA targeting sequence
cuauccuuuccgcaaacuuc

SEQ ID NO: 42564 - RNA, 20 nt, Artificial Sequence
  CIITA targeting sequence
uuuccgcaaacuucacugaa

SEQ ID NO: 42565 - RNA, 20 nt, Artificial Sequence
  CIITA targeting sequence
gcaaacuucacugaacaucu

SEQ ID NO: 42566 - RNA, 20 nt, Artificial Sequence
  CIITA targeting sequence
cugaacaucucgcagaacuu

SEQ ID NO: 42567 - RNA, 20 nt, Artificial Sequence
  CIITA targeting sequence
gugaaguuugcggaaaggau

SEQ ID NO: 42568 - RNA, 20 nt, Artificial Sequence
  CIITA targeting sequence
cgcagaacuuguauguuaaa

SEQ ID NO: 42569 - RNA, 20 nt, Artificial Sequence
  CIITA targeting sequence
cagaacuuguauguuaaaca

SEQ ID NO: 42570 - RNA, 20 nt, Artificial Sequence
  CIITA targeting sequence
gcgagauguucagugaaguu

SEQ ID NO: 42571 - RNA, 20 nt, Artificial Sequence
  CIITA targeting sequence
cauguuuaacauacaaguuc

SEQ ID NO: 42572 - RNA, 20 nt, Artificial Sequence
  CIITA targeting sequence
aacaacaauacaugucacau

SEQ ID NO: 42573 - RNA, 20 nt, Artificial Sequence
  CIITA targeting sequence
auagcacccugucaaacaac

SEQ ID NO: 42574 - RNA, 20 nt, Artificial Sequence
  CIITA targeting sequence
uaccccaaaugucaauagca

SEQ ID NO: 42575 - RNA, 20 nt, Artificial Sequence
  CIITA targeting sequence
uggaggugggguggcuguuc

SEQ ID NO: 42576 - RNA, 20 nt, Artificial Sequence
  CIITA targeting sequence
aagaauuguccuaccccaaa

SEQ ID NO: 42577 - RNA, 20 nt, Artificial Sequence
  CIITA targeting sequence
gggcacugagcauuuagcag

SEQ ID NO: 42578 - RNA, 20 nt, Artificial Sequence
  CIITA targeting sequence
gugcccagaacagccacccc

SEQ ID NO: 42579 - RNA, 20 nt, Artificial Sequence
  CIITA targeting sequence
cuggcuccaggccacuaaau

SEQ ID NO: 42580 - RNA, 20 nt, Artificial Sequence
  CIITA targeting sequence
ggcuccaggccacuaaaugc

SEQ ID NO: 42581 - RNA, 20 nt, Artificial Sequence
  CIITA targeting sequence
aggccacuaaaugccaguag

SEQ ID NO: 42582 - RNA, 20 nt, Artificial Sequence
  CIITA targeting sequence
aguggccaggggugcuacug

SEQ ID NO: 42583 - RNA, 20 nt, Artificial Sequence
  CIITA targeting sequence
uacccuauuuccaaggucga

SEQ ID NO: 42584 - RNA, 20 nt, Artificial Sequence
  CIITA targeting sequence
aaggucgaccuaagggggcg

SEQ ID NO: 42585 - RNA, 20 nt, Artificial Sequence
  CIITA targeting sequence
accuaagggggcggaacugu

SEQ ID NO: 42586 - RNA, 20 nt, Artificial Sequence
  CIITA targeting sequence
accuuggaaauaggguagga

SEQ ID NO: 42587 - RNA, 20 nt, Artificial Sequence
  CIITA targeting sequence
gcccccuuaggucgaccuug

SEQ ID NO: 42588 - RNA, 20 nt, Artificial Sequence
  CIITA targeting sequence
auugagacccaugcaucgua

SEQ ID NO: 42589 - RNA, 20 nt, Artificial Sequence
  CIITA targeting sequence
auggaaacaguuccgccccc

SEQ ID NO: 42590 - RNA, 20 nt, Artificial Sequence
  CIITA targeting sequence
caauggaaacaguuccgccc

SEQ ID NO: 42591 - RNA, 20 nt, Artificial Sequence
  CIITA targeting sequence
uauaggauaagaaacugagg

SEQ ID NO: 42592 - RNA, 20 nt, Artificial Sequence
  CIITA targeting sequence
uauacgaugcaugggucuca

SEQ ID NO: 42593 - RNA, 20 nt, Artificial Sequence
  CIITA targeting sequence
uauccuauacgaugcauggg

SEQ ID NO: 42594 - RNA, 20 nt, Artificial Sequence
  CIITA targeting sequence
guuucuuauccuauacgaug

SEQ ID NO: 42595 - RNA, 20 nt, Artificial Sequence
  CIITA targeting sequence
uaucauuuaauaggauaaga

SEQ ID NO: 42596 - RNA, 20 nt, Artificial Sequence
  CIITA targeting sequence
uuuaauaggauaagaaauug

SEQ ID NO: 42597 - RNA, 20 nt, Artificial Sequence
  CIITA targeting sequence
uauuaaaugauaagaaccuc

SEQ ID NO: 42598 - RNA, 20 nt, Artificial Sequence
  CIITA targeting sequence
uauccuauuaaaugauaaga

SEQ ID NO: 42599 - RNA, 20 nt, Artificial Sequence
  CIITA targeting sequence
auuucuuauccuauuaaaug

SEQ ID NO: 42600 - RNA, 20 nt, Artificial Sequence
  CIITA targeting sequence
gagaagccaaguaaccugcc

SEQ ID NO: 42601 - RNA, 20 nt, Artificial Sequence
  CIITA targeting sequence
gaaccucaauuucuuauccu

SEQ ID NO: 42602 - RNA, 20 nt, Artificial Sequence
  CIITA targeting sequence
cugaaccucaauuucuuauc

SEQ ID NO: 42603 - RNA, 20 nt, Artificial Sequence
  CIITA targeting sequence
uuaggcagguuacuuggcuu

SEQ ID NO: 42604 - RNA, 20 nt, Artificial Sequence
  CIITA targeting sequence
uagcugugcaucuuuaggca

SEQ ID NO: 42605 - RNA, 20 nt, Artificial Sequence
  CIITA targeting sequence
cauagcugugcaucuuuagg

SEQ ID NO: 42606 - RNA, 20 nt, Artificial Sequence
  CIITA targeting sequence
uuauuaccaagccagugcca

SEQ ID NO: 42607 - RNA, 20 nt, Artificial Sequence
  CIITA targeting sequence
aucguuauuaccaagccagu

SEQ ID NO: 42608 - RNA, 20 nt, Artificial Sequence
  CIITA targeting sequence
gaaugagagcagguaccauu

SEQ ID NO: 42609 - RNA, 20 nt, Artificial Sequence
  CIITA targeting sequence
gaccguuuccaucguuauua

SEQ ID NO: 42610 - RNA, 20 nt, Artificial Sequence
  CIITA targeting sequence
uucagaccguuuccaucguu

SEQ ID NO: 42611 - RNA, 20 nt, Artificial Sequence
  CIITA targeting sequence
cauucagaccguuuccaucg

SEQ ID NO: 42612 - RNA, 20 nt, Artificial Sequence
  CIITA targeting sequence
ugagcucuuagcagacgcug

SEQ ID NO: 42613 - RNA, 20 nt, Artificial Sequence
  CIITA targeting sequence
ggaaaugguaccugcucuca

SEQ ID NO: 42614 - RNA, 20 nt, Artificial Sequence
  CIITA targeting sequence
uagcagacgcugaggacccu

SEQ ID NO: 42615 - RNA, 20 nt, Artificial Sequence
  CIITA targeting sequence
gcuaagagcucaggaaaugg

SEQ ID NO: 42616 - RNA, 20 nt, Artificial Sequence
  CIITA targeting sequence
gcgucugcuaagagcucagg

SEQ ID NO: 42617 - RNA, 20 nt, Artificial Sequence
  CIITA targeting sequence
ucagcgucugcuaagagcuc

SEQ ID NO: 42618 - RNA, 20 nt, Artificial Sequence
  CIITA targeting sequence
uggcacuuagcaggguccuc

SEQ ID NO: 42619 - RNA, 20 nt, Artificial Sequence
  CIITA targeting sequence
cauggcacuuagcagggucc

SEQ ID NO: 42620 - RNA, 20 nt, Artificial Sequence
  CIITA targeting sequence
gcuaaggucucauggcacuu

SEQ ID NO: 42621 - RNA, 20 nt, Artificial Sequence
  CIITA targeting sequence
cuccacucacucuuccuugc

SEQ ID NO: 42622 - RNA, 20 nt, Artificial Sequence
  CIITA targeting sequence
acucacucuuccuugcaggu

SEQ ID NO: 42623 - RNA, 20 nt, Artificial Sequence
  CIITA targeting sequence
cucuuccuugcaggucgacc

SEQ ID NO: 42624 - RNA, 20 nt, Artificial Sequence
  CIITA targeting sequence
uccuugcaggucgaccugcc

SEQ ID NO: 42625 - RNA, 20 nt, Artificial Sequence
  CIITA targeting sequence
uugcaggucgaccugcccuu

SEQ ID NO: 42626 - RNA, 20 nt, Artificial Sequence
  CIITA targeting sequence
accugcccuucuuugcugag

SEQ ID NO: 42627 - RNA, 20 nt, Artificial Sequence
  CIITA targeting sequence
accugcaaggaagagugagu

SEQ ID NO: 42628 - RNA, 20 nt, Artificial Sequence
  CIITA targeting sequence
uugcugaggccuuucucugc

SEQ ID NO: 42629 - RNA, 20 nt, Artificial Sequence
  CIITA targeting sequence
gcaaagaagggcaggucgac

SEQ ID NO: 42630 - RNA, 20 nt, Artificial Sequence
  CIITA targeting sequence
cugccuccagagccugcuug

SEQ ID NO: 42631 - RNA, 20 nt, Artificial Sequence
  CIITA targeting sequence
gccuccagagccugcuuggu

SEQ ID NO: 42632 - RNA, 20 nt, Artificial Sequence
  CIITA targeting sequence
agagccugcuugguccucag

SEQ ID NO: 42633 - RNA, 20 nt, Artificial Sequence
  CIITA targeting sequence
ggaggcagagaaaggccuca

SEQ ID NO: 42634 - RNA, 20 nt, Artificial Sequence
  CIITA targeting sequence
ucaggcuguaagugcaggca

SEQ ID NO: 42635 - RNA, 20 nt, Artificial Sequence
  CIITA targeting sequence
ggcuguaagugcaggcagag

SEQ ID NO: 42636 - RNA, 20 nt, Artificial Sequence
  CIITA targeting sequence
gccugcacuuacagccugag

SEQ ID NO: 42637 - RNA, 20 nt, Artificial Sequence
  CIITA targeting sequence
cuccauagcugcccuccacc

SEQ ID NO: 42638 - RNA, 20 nt, Artificial Sequence
  CIITA targeting sequence
ccauagcugcccuccaccag

SEQ ID NO: 42639 - RNA, 20 nt, Artificial Sequence
  CIITA targeting sequence
auagcugcccuccaccagcc

SEQ ID NO: 42640 - RNA, 20 nt, Artificial Sequence
  CIITA targeting sequence
accagccugcuccugagaca

SEQ ID NO: 42641 - RNA, 20 nt, Artificial Sequence
  CIITA targeting sequence
ugagacaccugcuggccagc

SEQ ID NO: 42642 - RNA, 20 nt, Artificial Sequence
  CIITA targeting sequence
ggagcaggcugguggagggc

SEQ ID NO: 42643 - RNA, 20 nt, Artificial Sequence
  CIITA targeting sequence
caggagcaggcugguggagg

SEQ ID NO: 42644 - RNA, 20 nt, Artificial Sequence
  CIITA targeting sequence
ggcugcuggccagcaggugu

SEQ ID NO: 42645 - RNA, 20 nt, Artificial Sequence
  CIITA targeting sequence
gcuucaggcugcuggccagc

SEQ ID NO: 42646 - RNA, 20 nt, Artificial Sequence
  CIITA targeting sequence
uuuacucagauucagccgca

SEQ ID NO: 42647 - RNA, 20 nt, Artificial Sequence
  CIITA targeting sequence
gauucagccgcacagaugcu

SEQ ID NO: 42648 - RNA, 20 nt, Artificial Sequence
  CIITA targeting sequence
gaguaaaggauucugcuuca

SEQ ID NO: 42649 - RNA, 20 nt, Artificial Sequence
  CIITA targeting sequence
gccgcacagaugcucacugc

SEQ ID NO: 42650 - RNA, 20 nt, Artificial Sequence
  CIITA targeting sequence
gugcggcugaaucugaguaa

SEQ ID NO: 42651 - RNA, 20 nt, Artificial Sequence
  CIITA targeting sequence
cugcagagaucuccaaggcc

SEQ ID NO: 42652 - RNA, 20 nt, Artificial Sequence
  CIITA targeting sequence
gcagugagcaucugugcggc

SEQ ID NO: 42653 - RNA, 20 nt, Artificial Sequence
  CIITA targeting sequence
cugcagugagcaucugugcg

SEQ ID NO: 42654 - RNA, 20 nt, Artificial Sequence
  CIITA targeting sequence
ccaaggccuguggucauccu

SEQ ID NO: 42655 - RNA, 20 nt, Artificial Sequence
  CIITA targeting sequence
aaggccuguggucauccuug

SEQ ID NO: 42656 - RNA, 20 nt, Artificial Sequence
  CIITA targeting sequence
uccuugagcccaucucagau

SEQ ID NO: 42657 - RNA, 20 nt, Artificial Sequence
  CIITA targeting sequence
uugagcccaucucagauuug

SEQ ID NO: 42658 - RNA, 20 nt, Artificial Sequence
  CIITA targeting sequence
aggaugaccacaggccuugg

SEQ ID NO: 42659 - RNA, 20 nt, Artificial Sequence
  CIITA targeting sequence
cagauuuguguggauagggu

SEQ ID NO: 42660 - RNA, 20 nt, Artificial Sequence
  CIITA targeting sequence
gauuuguguggauagggugu

SEQ ID NO: 42661 - RNA, 20 nt, Artificial Sequence
  CIITA targeting sequence
gagaugggcucaaggaugac

SEQ ID NO: 42662 - RNA, 20 nt, Artificial Sequence
  CIITA targeting sequence
acacaaaucugagaugggcu

SEQ ID NO: 42663 - RNA, 20 nt, Artificial Sequence
  CIITA targeting sequence
aacacccuauccacacaaau

SEQ ID NO: 42664 - RNA, 20 nt, Artificial Sequence
  CIITA targeting sequence
cuaacacccuauccacacaa

SEQ ID NO: 42665 - RNA, 20 nt, Artificial Sequence
  CIITA targeting sequence
auguucucuaacacccuauc

SEQ ID NO: 42666 - RNA, 20 nt, Artificial Sequence
  CIITA targeting sequence
gcuggauagagugguucaug

SEQ ID NO: 42667 - RNA, 20 nt, Artificial Sequence
  CIITA targeting sequence
agcugauuccauguucucua

SEQ ID NO: 42668 - RNA, 20 nt, Artificial Sequence
  CIITA targeting sequence
auccagcugauuccauguuc

SEQ ID NO: 42669 - RNA, 20 nt, Artificial Sequence
  CIITA targeting sequence
ugcuuguaaucccagcacuu

SEQ ID NO: 42670 - RNA, 20 nt, Artificial Sequence
  CIITA targeting sequence
cagcacuuugggaggcuggg

SEQ ID NO: 42671 - RNA, 20 nt, Artificial Sequence
  CIITA targeting sequence
caaagugcugggauuacaag

SEQ ID NO: 42672 - RNA, 20 nt, Artificial Sequence
  CIITA targeting sequence
caccccagccucccaaagug

SEQ ID NO: 42673 - RNA, 20 nt, Artificial Sequence
  CIITA targeting sequence
ucccaccccagccucccaaa

SEQ ID NO: 42674 - RNA, 20 nt, Artificial Sequence
  CIITA targeting sequence
cuugaggccaggaguuugag

SEQ ID NO: 42675 - RNA, 20 nt, Artificial Sequence
  CIITA targeting sequence
agugauccucccaccccagc

SEQ ID NO: 42676 - RNA, 20 nt, Artificial Sequence
  CIITA targeting sequence
uggccucaagugauccuccc

SEQ ID NO: 42677 - RNA, 20 nt, Artificial Sequence
  CIITA targeting sequence
aacuccuggccucaagugau

SEQ ID NO: 42678 - RNA, 20 nt, Artificial Sequence
  CIITA targeting sequence
caaacuccuggccucaagug

SEQ ID NO: 42679 - RNA, 20 nt, Artificial Sequence
  CIITA targeting sequence
cuguguugcccaggcugguc

SEQ ID NO: 42680 - RNA, 20 nt, Artificial Sequence
  CIITA targeting sequence
cacuguguugcccaggcugg

SEQ ID NO: 42681 - RNA, 20 nt, Artificial Sequence
  CIITA targeting sequence
cuauaaaaaauuuaaaaauu

SEQ ID NO: 42682 - RNA, 20 nt, Artificial Sequence
  CIITA targeting sequence
auaaaaaauuuaaaaauuag

SEQ ID NO: 42683 - RNA, 20 nt, Artificial Sequence
  CIITA targeting sequence
cagcuacuuggaaggcugag

SEQ ID NO: 42684 - RNA, 20 nt, Artificial Sequence
  CIITA targeting sequence
gcuacuuggaaggcugaggc

SEQ ID NO: 42685 - RNA, 20 nt, Artificial Sequence
  CIITA targeting sequence
aaguagcugagacuacacua

SEQ ID NO: 42686 - RNA, 20 nt, Artificial Sequence
  CIITA targeting sequence
gccuuccaaguagcugagac

SEQ ID NO: 42687 - RNA, 20 nt, Artificial Sequence
  CIITA targeting sequence
ugccucagccuuccaaguag

SEQ ID NO: 42688 - RNA, 20 nt, Artificial Sequence
  CIITA targeting sequence
uccugccucagccuuccaag

SEQ ID NO: 42689 - RNA, 20 nt, Artificial Sequence
  CIITA targeting sequence
cgcaauccuccugccucagc

SEQ ID NO: 42690 - RNA, 20 nt, Artificial Sequence
  CIITA targeting sequence
aggcugcagugaacuaugac

SEQ ID NO: 42691 - RNA, 20 nt, Artificial Sequence
  CIITA targeting sequence
cugcagccuugaacugcugg

SEQ ID NO: 42692 - RNA, 20 nt, Artificial Sequence
  CIITA targeting sequence
uaguucacugcagccuugaa

SEQ ID NO: 42693 - RNA, 20 nt, Artificial Sequence
  CIITA targeting sequence
cccaggcugggugcaggggc

SEQ ID NO: 42694 - RNA, 20 nt, Artificial Sequence
  CIITA targeting sequence
gucacccaggcugggugcag

SEQ ID NO: 42695 - RNA, 20 nt, Artificial Sequence
  CIITA targeting sequence
cugucacccaggcugggugc

SEQ ID NO: 42696 - RNA, 20 nt, Artificial Sequence
  CIITA targeting sequence
caaaaaaaagagaagaugga

SEQ ID NO: 42697 - RNA, 20 nt, Artificial Sequence
  CIITA targeting sequence
aaaaaaagagaagauggaau

SEQ ID NO: 42698 - RNA, 20 nt, Artificial Sequence
  CIITA targeting sequence
uuuuuuugagacagggucuc

SEQ ID NO: 42699 - RNA, 20 nt, Artificial Sequence
  CIITA targeting sequence
cuuuuuuuugagacaggguc

SEQ ID NO: 42700 - RNA, 20 nt, Artificial Sequence
  CIITA targeting sequence
ucucuuuuuuuugagacagg

SEQ ID NO: 42701 - RNA, 20 nt, Artificial Sequence
  CIITA targeting sequence
aucuucucuuuuuuuugaga

SEQ ID NO: 42702 - RNA, 20 nt, Artificial Sequence
  CIITA targeting sequence
cucggugaggaccucacucc

SEQ ID NO: 42703 - RNA, 20 nt, Artificial Sequence
  CIITA targeting sequence
gugaggaccucacuccucuc

SEQ ID NO: 42704 - RNA, 20 nt, Artificial Sequence
  CIITA targeting sequence
ccgagugauuccaucuucuc

SEQ ID NO: 42705 - RNA, 20 nt, Artificial Sequence
  CIITA targeting sequence
ucaccgagugauuccaucuu

SEQ ID NO: 42706 - RNA, 20 nt, Artificial Sequence
  CIITA targeting sequence
cuccucucccaguccuguga

SEQ ID NO: 42707 - RNA, 20 nt, Artificial Sequence
  CIITA targeting sequence
ucucccaguccugugaccac

SEQ ID NO: 42708 - RNA, 20 nt, Artificial Sequence
  CIITA targeting sequence
cccaguccugugaccacaaa

SEQ ID NO: 42709 - RNA, 20 nt, Artificial Sequence
  CIITA targeting sequence
caguccugugaccacaaacc

SEQ ID NO: 42710 - RNA, 20 nt, Artificial Sequence
  CIITA targeting sequence
ugugaccacaaaccgcaucc

SEQ ID NO: 42711 - RNA, 20 nt, Artificial Sequence
  CIITA targeting sequence
caggacugggagaggaguga

SEQ ID NO: 42712 - RNA, 20 nt, Artificial Sequence
  CIITA targeting sequence
ccgacagucccagccaggcg

SEQ ID NO: 42713 - RNA, 20 nt, Artificial Sequence
  CIITA targeting sequence
gggaugcgguuuguggucac

SEQ ID NO: 42714 - RNA, 20 nt, Artificial Sequence
  CIITA targeting sequence
cagccaggcgcuagucuggc

SEQ ID NO: 42715 - RNA, 20 nt, Artificial Sequence
  CIITA targeting sequence
ggcuguagcugcccucuugu

SEQ ID NO: 42716 - RNA, 20 nt, Artificial Sequence
  CIITA targeting sequence
ugugugcagaucuccagucu

SEQ ID NO: 42717 - RNA, 20 nt, Artificial Sequence
  CIITA targeting sequence
gcacacaagagggcagcuac

SEQ ID NO: 42718 - RNA, 20 nt, Artificial Sequence
  CIITA targeting sequence
ccagucugaaugggcuacac

SEQ ID NO: 42719 - RNA, 20 nt, Artificial Sequence
  CIITA targeting sequence
agucugaaugggcuacacgu

SEQ ID NO: 42720 - RNA, 20 nt, Artificial Sequence
  CIITA targeting sequence
gaaugggcuacacguggaau

SEQ ID NO: 42721 - RNA, 20 nt, Artificial Sequence
  CIITA targeting sequence
gacuggagaucugcacacaa

SEQ ID NO: 42722 - RNA, 20 nt, Artificial Sequence
  CIITA targeting sequence
acguguagcccauucagacu

SEQ ID NO: 42723 - RNA, 20 nt, Artificial Sequence
  CIITA targeting sequence
gguuuucauuguguuuaucu

SEQ ID NO: 42724 - RNA, 20 nt, Artificial Sequence
  CIITA targeting sequence
uuguguuuaucuguaggguu

SEQ ID NO: 42725 - RNA, 20 nt, Artificial Sequence
  CIITA targeting sequence
guaggguuaccuucuauuua

SEQ ID NO: 42726 - RNA, 20 nt, Artificial Sequence
  CIITA targeting sequence
auuuauagcaagugaugcca

SEQ ID NO: 42727 - RNA, 20 nt, Artificial Sequence
  CIITA targeting sequence
cuugcuauaaauagaaggua

SEQ ID NO: 42728 - RNA, 20 nt, Artificial Sequence
  CIITA targeting sequence
auuucugguaguaauauagu

SEQ ID NO: 42729 - RNA, 20 nt, Artificial Sequence
  CIITA targeting sequence
gguaguaauauaguuuuucu

SEQ ID NO: 42730 - RNA, 20 nt, Artificial Sequence
  CIITA targeting sequence
uuuccaagucgcucacaccu

SEQ ID NO: 42731 - RNA, 20 nt, Artificial Sequence
  CIITA targeting sequence
aagucgcucacaccuguaau

SEQ ID NO: 42732 - RNA, 20 nt, Artificial Sequence
  CIITA targeting sequence
cucacaccuguaaucccaac

SEQ ID NO: 42733 - RNA, 20 nt, Artificial Sequence
  CIITA targeting sequence
caccuguaaucccaacacuu

SEQ ID NO: 42734 - RNA, 20 nt, Artificial Sequence
  CIITA targeting sequence
caacacuuugggaggcuaag

SEQ ID NO: 42735 - RNA, 20 nt, Artificial Sequence
  CIITA targeting sequence
caaaguguugggauuacagg

SEQ ID NO: 42736 - RNA, 20 nt, Artificial Sequence
  CIITA targeting sequence
acccaccuuagccucccaaa

SEQ ID NO: 42737 - RNA, 20 nt, Artificial Sequence
  CIITA targeting sequence
guugagaucaggaguuugag

SEQ ID NO: 42738 - RNA, 20 nt, Artificial Sequence
  CIITA targeting sequence
acugauccacccaccuuagc

SEQ ID NO: 42739 - RNA, 20 nt, Artificial Sequence
  CIITA targeting sequence
caacugauccacccaccuua

SEQ ID NO: 42740 - RNA, 20 nt, Artificial Sequence
  CIITA targeting sequence
ggaguuugagaccagccugg

SEQ ID NO: 42741 - RNA, 20 nt, Artificial Sequence
  CIITA targeting sequence
ugaucucaacugauccaccc

SEQ ID NO: 42742 - RNA, 20 nt, Artificial Sequence
  CIITA targeting sequence
aacuccugaucucaacugau

SEQ ID NO: 42743 - RNA, 20 nt, Artificial Sequence
  CIITA targeting sequence
caaacuccugaucucaacug

SEQ ID NO: 42744 - RNA, 20 nt, Artificial Sequence
  CIITA targeting sequence
ccauguuggccaggcugguc

SEQ ID NO: 42745 - RNA, 20 nt, Artificial Sequence
  CIITA targeting sequence
uuucgccauguuggccaggc

SEQ ID NO: 42746 - RNA, 20 nt, Artificial Sequence
  CIITA targeting sequence
agacuagccuggccaacaug

SEQ ID NO: 42747 - RNA, 20 nt, Artificial Sequence
  CIITA targeting sequence
ugaccucauuucgccauguu

SEQ ID NO: 42748 - RNA, 20 nt, Artificial Sequence
  CIITA targeting sequence
ccauguuggccaggcuaguc

SEQ ID NO: 42749 - RNA, 20 nt, Artificial Sequence
  CIITA targeting sequence
cuacuaaaaacaaacaaaca

SEQ ID NO: 42750 - RNA, 20 nt, Artificial Sequence
  CIITA targeting sequence
acuaaaaacaaacaaacaaa

SEQ ID NO: 42751 - RNA, 20 nt, Artificial Sequence
  CIITA targeting sequence
cugggcaugguggcaggugc

SEQ ID NO: 42752 - RNA, 20 nt, Artificial Sequence
  CIITA targeting sequence
ggcaccugccaccaugccca

SEQ ID NO: 42753 - RNA, 20 nt, Artificial Sequence
  CIITA targeting sequence
cagcuacucgggaggcugag

SEQ ID NO: 42754 - RNA, 20 nt, Artificial Sequence
  CIITA targeting sequence
ggaggcugaggcagaagaau

SEQ ID NO: 42755 - RNA, 20 nt, Artificial Sequence
  CIITA targeting sequence
cgaguagcugggaccucagg

SEQ ID NO: 42756 - RNA, 20 nt, Artificial Sequence
  CIITA targeting sequence
gccucccgaguagcugggac

SEQ ID NO: 42757 - RNA, 20 nt, Artificial Sequence
  CIITA targeting sequence
gccucagccucccgaguagc

SEQ ID NO: 42758 - RNA, 20 nt, Artificial Sequence
  CIITA targeting sequence
ucugccucagccucccgagu

SEQ ID NO: 42759 - RNA, 20 nt, Artificial Sequence
  CIITA targeting sequence
cuugagcuagggaggcagag

SEQ ID NO: 42760 - RNA, 20 nt, Artificial Sequence
  CIITA targeting sequence
agcgauucuucugccucagc

SEQ ID NO: 42761 - RNA, 20 nt, Artificial Sequence
  CIITA targeting sequence
cuagcucaagcgauucuucu

SEQ ID NO: 42762 - RNA, 20 nt, Artificial Sequence
  CIITA targeting sequence
gccucccuagcucaagcgau

SEQ ID NO: 42763 - RNA, 20 nt, Artificial Sequence
  CIITA targeting sequence
cugcaaccucugccucccua

SEQ ID NO: 42764 - RNA, 20 nt, Artificial Sequence
  CIITA targeting sequence
gcucacugcaaccucugccu

SEQ ID NO: 42765 - RNA, 20 nt, Artificial Sequence
  CIITA targeting sequence
cggcucacugcaaccucugc

SEQ ID NO: 42766 - RNA, 20 nt, Artificial Sequence
  CIITA targeting sequence
cgccacugcacuauagccua

SEQ ID NO: 42767 - RNA, 20 nt, Artificial Sequence
  CIITA targeting sequence
ccuaggcuauagugcagugg

SEQ ID NO: 42768 - RNA, 20 nt, Artificial Sequence
  CIITA targeting sequence
gucaccuaggcuauagugca

SEQ ID NO: 42769 - RNA, 20 nt, Artificial Sequence
  CIITA targeting sequence
cucugucaccuaggcuauag

SEQ ID NO: 42770 - RNA, 20 nt, Artificial Sequence
  CIITA targeting sequence
cacucugucaccuaggcuau

SEQ ID NO: 42771 - RNA, 20 nt, Artificial Sequence
  CIITA targeting sequence
gucucaaaaaaacacaaaag

SEQ ID NO: 42772 - RNA, 20 nt, Artificial Sequence
  CIITA targeting sequence
caaaaaaacacaaaaguuuc

SEQ ID NO: 42773 - RNA, 20 nt, Artificial Sequence
  CIITA targeting sequence
aaaaaacacaaaaguuucuc

SEQ ID NO: 42774 - RNA, 20 nt, Artificial Sequence
  CIITA targeting sequence
cuuuucaaaacauuuuacuu

SEQ ID NO: 42775 - RNA, 20 nt, Artificial Sequence
  CIITA targeting sequence
uuucaaaacauuuuacuuua

SEQ ID NO: 42776 - RNA, 20 nt, Artificial Sequence
  CIITA targeting sequence
aaacauuuuacuuuaaaagg

SEQ ID NO: 42777 - RNA, 20 nt, Artificial Sequence
  CIITA targeting sequence
uuuuaaaguaaaauguuuug

SEQ ID NO: 42778 - RNA, 20 nt, Artificial Sequence
  CIITA targeting sequence
uuaaauuggcuccuuuuaaa

SEQ ID NO: 42779 - RNA, 20 nt, Artificial Sequence
  CIITA targeting sequence
gguaacaggcagauacagga

SEQ ID NO: 42780 - RNA, 20 nt, Artificial Sequence
  CIITA targeting sequence
gccuguuaccugaacuauua

SEQ ID NO: 42781 - RNA, 20 nt, Artificial Sequence
  CIITA targeting sequence
uguaucugccuguuaccuga

SEQ ID NO: 42782 - RNA, 20 nt, Artificial Sequence
  CIITA targeting sequence
gcagcuuuuccuguaucugc

SEQ ID NO: 42783 - RNA, 20 nt, Artificial Sequence
  CIITA targeting sequence
uacaacacugucagcagcuu

SEQ ID NO: 42784 - RNA, 20 nt, Artificial Sequence
  CIITA targeting sequence
aaccucauacaacacuguca

SEQ ID NO: 42785 - RNA, 20 nt, Artificial Sequence
  CIITA targeting sequence
ucaaaccucauacaacacug

SEQ ID NO: 42786 - RNA, 20 nt, Artificial Sequence
  CIITA targeting sequence
aaauccucaaaccucauaca

SEQ ID NO: 42787 - RNA, 20 nt, Artificial Sequence
  CIITA targeting sequence
aagcuggucccacucagucc

SEQ ID NO: 42788 - RNA, 20 nt, Artificial Sequence
  CIITA targeting sequence
cacucaguccauagcagaga

SEQ ID NO: 42789 - RNA, 20 nt, Artificial Sequence
  CIITA targeting sequence
guccauagcagagaaugaaa

SEQ ID NO: 42790 - RNA, 20 nt, Artificial Sequence
  CIITA targeting sequence
auagcagagaaugaaagggc

SEQ ID NO: 42791 - RNA, 20 nt, Artificial Sequence
  CIITA targeting sequence
gcuauggacugagugggacc

SEQ ID NO: 42792 - RNA, 20 nt, Artificial Sequence
  CIITA targeting sequence
cugcuauggacugaguggga

SEQ ID NO: 42793 - RNA, 20 nt, Artificial Sequence
  CIITA targeting sequence
uucucugcuauggacugagu

SEQ ID NO: 42794 - RNA, 20 nt, Artificial Sequence
  CIITA targeting sequence
gggcccuuucauucucugcu

SEQ ID NO: 42795 - RNA, 20 nt, Artificial Sequence
  CIITA targeting sequence
cugggcccuuucauucucug

SEQ ID NO: 42796 - RNA, 20 nt, Artificial Sequence
  CIITA targeting sequence
ccacccucucugggcccuuu

SEQ ID NO: 42797 - RNA, 20 nt, Artificial Sequence
  CIITA targeting sequence
gccugaagucacacagugag

SEQ ID NO: 42798 - RNA, 20 nt, Artificial Sequence
  CIITA targeting sequence
ggcagaggucaccacccucu

SEQ ID NO: 42799 - RNA, 20 nt, Artificial Sequence
  CIITA targeting sequence
cacagugagucgaggacagg

SEQ ID NO: 42800 - RNA, 20 nt, Artificial Sequence
  CIITA targeting sequence
cugugugacuucaggcagag

SEQ ID NO: 42801 - RNA, 20 nt, Artificial Sequence
  CIITA targeting sequence
aggacagggaggugacccca

SEQ ID NO: 42802 - RNA, 20 nt, Artificial Sequence
  CIITA targeting sequence
acucacugugugacuucagg

SEQ ID NO: 42803 - RNA, 20 nt, Artificial Sequence
  CIITA targeting sequence
ucgacucacugugugacuuc

SEQ ID NO: 42804 - RNA, 20 nt, Artificial Sequence
  CIITA targeting sequence
cuguccucgacucacugugu

SEQ ID NO: 42805 - RNA, 20 nt, Artificial Sequence
  CIITA targeting sequence
ccucccuguccucgacucac

SEQ ID NO: 42806 - RNA, 20 nt, Artificial Sequence
  CIITA targeting sequence
auguguagggcgggaggaug

SEQ ID NO: 42807 - RNA, 20 nt, Artificial Sequence
  CIITA targeting sequence
cgcccuacacauagaaaccu

SEQ ID NO: 42808 - RNA, 20 nt, Artificial Sequence
  CIITA targeting sequence
ucccgcccuacacauagaaa

SEQ ID NO: 42809 - RNA, 20 nt, Artificial Sequence
  CIITA targeting sequence
gggacacaguucaauucuca

SEQ ID NO: 42810 - RNA, 20 nt, Artificial Sequence
  CIITA targeting sequence
cagaacauccucccgcccua

SEQ ID NO: 42811 - RNA, 20 nt, Artificial Sequence
  CIITA targeting sequence
auucucauuugucacacacu

SEQ ID NO: 42812 - RNA, 20 nt, Artificial Sequence
  CIITA targeting sequence
cauuugucacacacuuuggc

SEQ ID NO: 42813 - RNA, 20 nt, Artificial Sequence
  CIITA targeting sequence
uuugucacacacuuuggcua

SEQ ID NO: 42814 - RNA, 20 nt, Artificial Sequence
  CIITA targeting sequence
cacacuuuggcuauuagaga

SEQ ID NO: 42815 - RNA, 20 nt, Artificial Sequence
  CIITA targeting sequence
aauagccaaagugugugaca

SEQ ID NO: 42816 - RNA, 20 nt, Artificial Sequence
  CIITA targeting sequence
cuaauagccaaaguguguga

SEQ ID NO: 42817 - RNA, 20 nt, Artificial Sequence
  CIITA targeting sequence
accccuucgcuccugugucu

SEQ ID NO: 42818 - RNA, 20 nt, Artificial Sequence
  CIITA targeting sequence
cuccugugucuugcaauggc

SEQ ID NO: 42819 - RNA, 20 nt, Artificial Sequence
  CIITA targeting sequence
ugugucuugcaauggcagcc

SEQ ID NO: 42820 - RNA, 20 nt, Artificial Sequence
  CIITA targeting sequence
ugcaauggcagccuuggcaa

SEQ ID NO: 42821 - RNA, 20 nt, Artificial Sequence
  CIITA targeting sequence
uuuagcguuugccaaggcug

SEQ ID NO: 42822 - RNA, 20 nt, Artificial Sequence
  CIITA targeting sequence
ugacaacacuuguguuauga

SEQ ID NO: 42823 - RNA, 20 nt, Artificial Sequence
  CIITA targeting sequence
cgauuuucauuuagcguuug

SEQ ID NO: 42824 - RNA, 20 nt, Artificial Sequence
  CIITA targeting sequence
uaacacaaguguugucacga

SEQ ID NO: 42825 - RNA, 20 nt, Artificial Sequence
  CIITA targeting sequence
ccuuguacuacucgaacuca

SEQ ID NO: 42826 - RNA, 20 nt, Artificial Sequence
  CIITA targeting sequence
aacucaugucuuaacucacu

SEQ ID NO: 42827 - RNA, 20 nt, Artificial Sequence
  CIITA targeting sequence
aguaguacaaggugaacaca

SEQ ID NO: 42828 - RNA, 20 nt, Artificial Sequence
  CIITA targeting sequence
ugucuuaacucacuuauccc

SEQ ID NO: 42829 - RNA, 20 nt, Artificial Sequence
  CIITA targeting sequence
uaacucacuuaucccucaaa

SEQ ID NO: 42830 - RNA, 20 nt, Artificial Sequence
  CIITA targeting sequence
cuuaucccucaaaaacaacu

SEQ ID NO: 42831 - RNA, 20 nt, Artificial Sequence
  CIITA targeting sequence
cucaaaaacaacucuaggag

SEQ ID NO: 42832 - RNA, 20 nt, Artificial Sequence
  CIITA targeting sequence
aaaacaacucuaggagguag

SEQ ID NO: 42833 - RNA, 20 nt, Artificial Sequence
  CIITA targeting sequence
aggagguagggccaaguagg

SEQ ID NO: 42834 - RNA, 20 nt, Artificial Sequence
  CIITA targeting sequence
uagaguuguuuuugagggau

SEQ ID NO: 42835 - RNA, 20 nt, Artificial Sequence
  CIITA targeting sequence
uacuuggcccuaccuccuag

SEQ ID NO: 42836 - RNA, 20 nt, Artificial Sequence
  CIITA targeting sequence
ucccugcauuucacauggag

SEQ ID NO: 42837 - RNA, 20 nt, Artificial Sequence
  CIITA targeting sequence
cugcauuucacauggagcuc

SEQ ID NO: 42838 - RNA, 20 nt, Artificial Sequence
  CIITA targeting sequence
cauggagcucagagagguua

SEQ ID NO: 42839 - RNA, 20 nt, Artificial Sequence
  CIITA targeting sequence
augugaaaugcagggaugau

SEQ ID NO: 42840 - RNA, 20 nt, Artificial Sequence
  CIITA targeting sequence
gagagguuaagcaagccgug

SEQ ID NO: 42841 - RNA, 20 nt, Artificial Sequence
  CIITA targeting sequence
gagcuccaugugaaaugcag

SEQ ID NO: 42842 - RNA, 20 nt, Artificial Sequence
  CIITA targeting sequence
cugagcuccaugugaaaugc

SEQ ID NO: 42843 - RNA, 20 nt, Artificial Sequence
  CIITA targeting sequence
uaaauggcagagccaggauu

SEQ ID NO: 42844 - RNA, 20 nt, Artificial Sequence
  CIITA targeting sequence
gccauuuaugagcugugugg

SEQ ID NO: 42845 - RNA, 20 nt, Artificial Sequence
  CIITA targeting sequence
uggcucugccauuuaugagc

SEQ ID NO: 42846 - RNA, 20 nt, Artificial Sequence
  CIITA targeting sequence
aauccuggcucugccauuua

SEQ ID NO: 42847 - RNA, 20 nt, Artificial Sequence
  CIITA targeting sequence
ggccacggggguucaaaucc

SEQ ID NO: 42848 - RNA, 20 nt, Artificial Sequence
  CIITA targeting sequence
gcuuuggggucaggccacgg

SEQ ID NO: 42849 - RNA, 20 nt, Artificial Sequence
  CIITA targeting sequence
gcacugcagguucgucccuu

SEQ ID NO: 42850 - RNA, 20 nt, Artificial Sequence
  CIITA targeting sequence
ucccuuuucucugagauggg

SEQ ID NO: 42851 - RNA, 20 nt, Artificial Sequence
  CIITA targeting sequence
cuuuucucugagaugggggu

SEQ ID NO: 42852 - RNA, 20 nt, Artificial Sequence
  CIITA targeting sequence
cugagauggggguauccaau

SEQ ID NO: 42853 - RNA, 20 nt, Artificial Sequence
  CIITA targeting sequence
gagauggggguauccaaucu

SEQ ID NO: 42854 - RNA, 20 nt, Artificial Sequence
  CIITA targeting sequence
gagaaaagggacgaaccugc

SEQ ID NO: 42855 - RNA, 20 nt, Artificial Sequence
  CIITA targeting sequence
cagagaaaagggacgaaccu

SEQ ID NO: 42856 - RNA, 20 nt, Artificial Sequence
  CIITA targeting sequence
aaucuuuuggcuucccuggg

SEQ ID NO: 42857 - RNA, 20 nt, Artificial Sequence
  CIITA targeting sequence
uuuggcuucccugggccaca

SEQ ID NO: 42858 - RNA, 20 nt, Artificial Sequence
  CIITA targeting sequence
cugggccacaguggaagaac

SEQ ID NO: 42859 - RNA, 20 nt, Artificial Sequence
  CIITA targeting sequence
acuguggcccagggaagcca

SEQ ID NO: 42860 - RNA, 20 nt, Artificial Sequence
  CIITA targeting sequence
uccacuguggcccagggaag

SEQ ID NO: 42861 - RNA, 20 nt, Artificial Sequence
  CIITA targeting sequence
ggggccacauauaaaauaua

SEQ ID NO: 42862 - RNA, 20 nt, Artificial Sequence
  CIITA targeting sequence
uuaguauauuuuauaugugg

SEQ ID NO: 42863 - RNA, 20 nt, Artificial Sequence
  CIITA targeting sequence
ugagcuaaaaaauaaaacaa

SEQ ID NO: 42864 - RNA, 20 nt, Artificial Sequence
  CIITA targeting sequence
ugagcuaucauuaguauauu

SEQ ID NO: 42865 - RNA, 20 nt, Artificial Sequence
  CIITA targeting sequence
cacacacacacacaaaaaaa

SEQ ID NO: 42866 - RNA, 20 nt, Artificial Sequence
  CIITA targeting sequence
uuuuuuuuuuuuuuuuuuga

SEQ ID NO: 42867 - RNA, 20 nt, Artificial Sequence
  CIITA targeting sequence
aaaaaaaaaaaaaaaaaaga

SEQ ID NO: 42868 - RNA, 20 nt, Artificial Sequence
  CIITA targeting sequence
caaaaaaaaaaaaaaaaaaa

SEQ ID NO: 42869 - RNA, 20 nt, Artificial Sequence
  CIITA targeting sequence
ugcuuugucacccaggcugg

SEQ ID NO: 42870 - RNA, 20 nt, Artificial Sequence
  CIITA targeting sequence
cccaggcuggagggcagugg

SEQ ID NO: 42871 - RNA, 20 nt, Artificial Sequence
  CIITA targeting sequence
agccugggugacaaagcaag

SEQ ID NO: 42872 - RNA, 20 nt, Artificial Sequence
  CIITA targeting sequence
ugccacugcccuccagccug

SEQ ID NO: 42873 - RNA, 20 nt, Artificial Sequence
  CIITA targeting sequence
uggcucacugcaguuccagg

SEQ ID NO: 42874 - RNA, 20 nt, Artificial Sequence
  CIITA targeting sequence
cugcaguuccagguucaagc

SEQ ID NO: 42875 - RNA, 20 nt, Artificial Sequence
  CIITA targeting sequence
agguucaagcaauucucaug

SEQ ID NO: 42876 - RNA, 20 nt, Artificial Sequence
  CIITA targeting sequence
agcaauucucaugccucagc

SEQ ID NO: 42877 - RNA, 20 nt, Artificial Sequence
  CIITA targeting sequence
caugccucagccuccugagu

SEQ ID NO: 42878 - RNA, 20 nt, Artificial Sequence
  CIITA targeting sequence
ugccucagccuccugaguag

SEQ ID NO: 42879 - RNA, 20 nt, Artificial Sequence
  CIITA targeting sequence
gccuccugaguagcugggac

SEQ ID NO: 42880 - RNA, 20 nt, Artificial Sequence
  CIITA targeting sequence
ugaguagcugggacuacagg

SEQ ID NO: 42881 - RNA, 20 nt, Artificial Sequence
  CIITA targeting sequence
ggaggcugaggcaugagaau

SEQ ID NO: 42882 - RNA, 20 nt, Artificial Sequence
  CIITA targeting sequence
cagcuacucaggaggcugag

SEQ ID NO: 42883 - RNA, 20 nt, Artificial Sequence
  CIITA targeting sequence
ccaugccuggcuaauugaug

SEQ ID NO: 42884 - RNA, 20 nt, Artificial Sequence
  CIITA targeting sequence
auuagccaggcauggugaca

SEQ ID NO: 42885 - RNA, 20 nt, Artificial Sequence
  CIITA targeting sequence
acuaaaaaauacaucaauua

SEQ ID NO: 42886 - RNA, 20 nt, Artificial Sequence
  CIITA targeting sequence
cuacuaaaaaauacaucaau

SEQ ID NO: 42887 - RNA, 20 nt, Artificial Sequence
  CIITA targeting sequence
ccauguuggccaggcuaaaa

SEQ ID NO: 42888 - RNA, 20 nt, Artificial Sequence
  CIITA targeting sequence
cauaacguuuuaagaaaguu

SEQ ID NO: 42889 - RNA, 20 nt, Artificial Sequence
  CIITA targeting sequence
uaacguuuuaagaaaguuua

SEQ ID NO: 42890 - RNA, 20 nt, Artificial Sequence
  CIITA targeting sequence
uaaaacguuaugagauuuua

SEQ ID NO: 42891 - RNA, 20 nt, Artificial Sequence
  CIITA targeting sequence
uaaacuuucuuaaaacguua

SEQ ID NO: 42892 - RNA, 20 nt, Artificial Sequence
  CIITA targeting sequence
guguugggccacagucaaag

SEQ ID NO: 42893 - RNA, 20 nt, Artificial Sequence
  CIITA targeting sequence
aagccguccugagcuguaug

SEQ ID NO: 42894 - RNA, 20 nt, Artificial Sequence
  CIITA targeting sequence
ugagcuguaugcagccuaca

SEQ ID NO: 42895 - RNA, 20 nt, Artificial Sequence
  CIITA targeting sequence
ggacggcuuugacuguggcc

SEQ ID NO: 42896 - RNA, 20 nt, Artificial Sequence
  CIITA targeting sequence
guggugcggccuguaggcug

SEQ ID NO: 42897 - RNA, 20 nt, Artificial Sequence
  CIITA targeting sequence
auccguggugcggccuguag

SEQ ID NO: 42898 - RNA, 20 nt, Artificial Sequence
  CIITA targeting sequence
ucuaaggcaucaagagcccc

SEQ ID NO: 42899 - RNA, 20 nt, Artificial Sequence
  CIITA targeting sequence
aaggcaucaagagccccagg

SEQ ID NO: 42900 - RNA, 20 nt, Artificial Sequence
  CIITA targeting sequence
agagccccaggcugaaaagc

SEQ ID NO: 42901 - RNA, 20 nt, Artificial Sequence
  CIITA targeting sequence
ugaugccuuagaagaaacuu

SEQ ID NO: 42902 - RNA, 20 nt, Artificial Sequence
  CIITA targeting sequence
gccuggggcucuugaugccu

SEQ ID NO: 42903 - RNA, 20 nt, Artificial Sequence
  CIITA targeting sequence
ggggugcuuuucagccuggg

SEQ ID NO: 42904 - RNA, 20 nt, Artificial Sequence
  CIITA targeting sequence
agcucuggggugcuuuucag

SEQ ID NO: 42905 - RNA, 20 nt, Artificial Sequence
  CIITA targeting sequence
auaagcuccagcucuggggu

SEQ ID NO: 42906 - RNA, 20 nt, Artificial Sequence
  CIITA targeting sequence
ccaaccuucugacaucauca

SEQ ID NO: 42907 - RNA, 20 nt, Artificial Sequence
  CIITA targeting sequence
aaccuucugacaucaucaga

SEQ ID NO: 42908 - RNA, 20 nt, Artificial Sequence
  CIITA targeting sequence
gacaucaucagagcacagca

SEQ ID NO: 42909 - RNA, 20 nt, Artificial Sequence
  CIITA targeting sequence
gaagguuggagaaccugcug

SEQ ID NO: 42910 - RNA, 20 nt, Artificial Sequence
  CIITA targeting sequence
ucagagcacagcagacaagu

SEQ ID NO: 42911 - RNA, 20 nt, Artificial Sequence
  CIITA targeting sequence
gagcacagcagacaaguuau

SEQ ID NO: 42912 - RNA, 20 nt, Artificial Sequence
  CIITA targeting sequence
gaugaugucagaagguugga

SEQ ID NO: 42913 - RNA, 20 nt, Artificial Sequence
  CIITA targeting sequence
gcugugcucugaugauguca

SEQ ID NO: 42914 - RNA, 20 nt, Artificial Sequence
  CIITA targeting sequence
gccacuagauuuuuuucccc

SEQ ID NO: 42915 - RNA, 20 nt, Artificial Sequence
  CIITA targeting sequence
aguggcugauaacuugucug

SEQ ID NO: 42916 - RNA, 20 nt, Artificial Sequence
  CIITA targeting sequence
cccuuucugaaacuguaacc

SEQ ID NO: 42917 - RNA, 20 nt, Artificial Sequence
  CIITA targeting sequence
gaaacuguaaccuuucauuc

SEQ ID NO: 42918 - RNA, 20 nt, Artificial Sequence
  CIITA targeting sequence
gaaagggggaaaaaaaucua

SEQ ID NO: 42919 - RNA, 20 nt, Artificial Sequence
  CIITA targeting sequence
uuccagccauuccccagagc

SEQ ID NO: 42920 - RNA, 20 nt, Artificial Sequence
  CIITA targeting sequence
agccauuccccagagcugga

SEQ ID NO: 42921 - RNA, 20 nt, Artificial Sequence
  CIITA targeting sequence
ccagagcuggacagaggacg

SEQ ID NO: 42922 - RNA, 20 nt, Artificial Sequence
  CIITA targeting sequence
ggggaauggcuggaaugaaa

SEQ ID NO: 42923 - RNA, 20 nt, Artificial Sequence
  CIITA targeting sequence
agcucuggggaauggcugga

SEQ ID NO: 42924 - RNA, 20 nt, Artificial Sequence
  CIITA targeting sequence
guccagcucuggggaauggc

SEQ ID NO: 42925 - RNA, 20 nt, Artificial Sequence
  CIITA targeting sequence
ucuguccagcucuggggaau

SEQ ID NO: 42926 - RNA, 20 nt, Artificial Sequence
  CIITA targeting sequence
guagucagaaugacaguugg

SEQ ID NO: 42927 - RNA, 20 nt, Artificial Sequence
  CIITA targeting sequence
gaaugacaguugggugcuag

SEQ ID NO: 42928 - RNA, 20 nt, Artificial Sequence
  CIITA targeting sequence
gacuacagaaaccagccagc

SEQ ID NO: 42929 - RNA, 20 nt, Artificial Sequence
  CIITA targeting sequence
uucugacuacagaaaccagc

SEQ ID NO: 42930 - RNA, 20 nt, Artificial Sequence
  CIITA targeting sequence
agcacccaacugucauucug

SEQ ID NO: 42931 - RNA, 20 nt, Artificial Sequence
  CIITA targeting sequence
ccuucgugaagcaaugucuu

SEQ ID NO: 42932 - RNA, 20 nt, Artificial Sequence
  CIITA targeting sequence
ugaagcaaugucuuagcuca

SEQ ID NO: 42933 - RNA, 20 nt, Artificial Sequence
  CIITA targeting sequence
cgaaggggaucuagcaccca

SEQ ID NO: 42934 - RNA, 20 nt, Artificial Sequence
  CIITA targeting sequence
uagcucaguaacucugcaga

SEQ ID NO: 42935 - RNA, 20 nt, Artificial Sequence
  CIITA targeting sequence
guaacucugcagagaagcug

SEQ ID NO: 42936 - RNA, 20 nt, Artificial Sequence
  CIITA targeting sequence
gcagagaagcugccugguuc

SEQ ID NO: 42937 - RNA, 20 nt, Artificial Sequence
  CIITA targeting sequence
gcagaguuacugagcuaaga

SEQ ID NO: 42938 - RNA, 20 nt, Artificial Sequence
  CIITA targeting sequence
cugcagaguuacugagcuaa

SEQ ID NO: 42939 - RNA, 20 nt, Artificial Sequence
  CIITA targeting sequence
ggauguggcuuaaguaagaa

SEQ ID NO: 42940 - RNA, 20 nt, Artificial Sequence
  CIITA targeting sequence
ugaaccaggcagcuucucug

SEQ ID NO: 42941 - RNA, 20 nt, Artificial Sequence
  CIITA targeting sequence
uacuuaagccacauccugaa

SEQ ID NO: 42942 - RNA, 20 nt, Artificial Sequence
  CIITA targeting sequence
ucuuacuuaagccacauccu

SEQ ID NO: 42943 - RNA, 20 nt, Artificial Sequence
  CIITA targeting sequence
cccaccagugcgcguaaaac

SEQ ID NO: 42944 - RNA, 20 nt, Artificial Sequence
  CIITA targeting sequence
gaaagugguagaagggaauu

SEQ ID NO: 42945 - RNA, 20 nt, Artificial Sequence
  CIITA targeting sequence
gagccucacccaccagugcg

SEQ ID NO: 42946 - RNA, 20 nt, Artificial Sequence
  CIITA targeting sequence
accacuuucagagccucacc

SEQ ID NO: 42947 - RNA, 20 nt, Artificial Sequence
  CIITA targeting sequence
cuucuaccacuuucagagcc

SEQ ID NO: 42948 - RNA, 20 nt, Artificial Sequence
  CIITA targeting sequence
uuccuagaguucagcugccc

SEQ ID NO: 42949 - RNA, 20 nt, Artificial Sequence
  CIITA targeting sequence
uagaguucagcugcccgcug

SEQ ID NO: 42950 - RNA, 20 nt, Artificial Sequence
  CIITA targeting sequence
aggaaagaauucccuucuac

SEQ ID NO: 42951 - RNA, 20 nt, Artificial Sequence
  CIITA targeting sequence
gcugcccgcuguccugcucc

SEQ ID NO: 42952 - RNA, 20 nt, Artificial Sequence
  CIITA targeting sequence
ugcuccucagggcaaaugcu

SEQ ID NO: 42953 - RNA, 20 nt, Artificial Sequence
  CIITA targeting sequence
ucagggcaaaugcugugaga

SEQ ID NO: 42954 - RNA, 20 nt, Artificial Sequence
  CIITA targeting sequence
gggcaaaugcugugagaucu

SEQ ID NO: 42955 - RNA, 20 nt, Artificial Sequence
  CIITA targeting sequence
cagcauuugcccugaggagc

SEQ ID NO: 42956 - RNA, 20 nt, Artificial Sequence
  CIITA targeting sequence
cacagcauuugcccugagga

SEQ ID NO: 42957 - RNA, 20 nt, Artificial Sequence
  CIITA targeting sequence
gcauuuagccugucugugcu

SEQ ID NO: 42958 - RNA, 20 nt, Artificial Sequence
  CIITA targeting sequence
gugcugauugugguucugcc

SEQ ID NO: 42959 - RNA, 20 nt, Artificial Sequence
  CIITA targeting sequence
gcacagacaggcuaaaugca

SEQ ID NO: 42960 - RNA, 20 nt, Artificial Sequence
  CIITA targeting sequence
gccccuuccuggcuguguga

SEQ ID NO: 42961 - RNA, 20 nt, Artificial Sequence
  CIITA targeting sequence
uggcugugugaccucagaca

SEQ ID NO: 42962 - RNA, 20 nt, Artificial Sequence
  CIITA targeting sequence
cacagccaggaaggggcaga

SEQ ID NO: 42963 - RNA, 20 nt, Artificial Sequence
  CIITA targeting sequence
gacaagucacccacccucuc

SEQ ID NO: 42964 - RNA, 20 nt, Artificial Sequence
  CIITA targeting sequence
gaggucacacagccaggaag

SEQ ID NO: 42965 - RNA, 20 nt, Artificial Sequence
  CIITA targeting sequence
cccacccucucugggccagu

SEQ ID NO: 42966 - RNA, 20 nt, Artificial Sequence
  CIITA targeting sequence
cugggccaguuuccucaucu

SEQ ID NO: 42967 - RNA, 20 nt, Artificial Sequence
  CIITA targeting sequence
gggccaguuuccucaucugg

SEQ ID NO: 42968 - RNA, 20 nt, Artificial Sequence
  CIITA targeting sequence
ucaucuggaaaaggggacag

SEQ ID NO: 42969 - RNA, 20 nt, Artificial Sequence
  CIITA targeting sequence
ucuggaaaaggggacagugc

SEQ ID NO: 42970 - RNA, 20 nt, Artificial Sequence
  CIITA targeting sequence
ggaaaaggggacagugccca

SEQ ID NO: 42971 - RNA, 20 nt, Artificial Sequence
  CIITA targeting sequence
agaugaggaaacuggcccag

SEQ ID NO: 42972 - RNA, 20 nt, Artificial Sequence
  CIITA targeting sequence
ccuuuuccagaugaggaaac

SEQ ID NO: 42973 - RNA, 20 nt, Artificial Sequence
  CIITA targeting sequence
auggagugccugacaauacc

SEQ ID NO: 42974 - RNA, 20 nt, Artificial Sequence
  CIITA targeting sequence
auggacacaaacagcccaau

SEQ ID NO: 42975 - RNA, 20 nt, Artificial Sequence
  CIITA targeting sequence
ggcacuccauggacacaaac

SEQ ID NO: 42976 - RNA, 20 nt, Artificial Sequence
  CIITA targeting sequence
ugugugcuggguauugucag

SEQ ID NO: 42977 - RNA, 20 nt, Artificial Sequence
  CIITA targeting sequence
cgugugugcuggguauuguc

SEQ ID NO: 42978 - RNA, 20 nt, Artificial Sequence
  CIITA targeting sequence
guacagggugguuccuuccc

SEQ ID NO: 42979 - RNA, 20 nt, Artificial Sequence
  CIITA targeting sequence
uucccuccuuagccccaccu

SEQ ID NO: 42980 - RNA, 20 nt, Artificial Sequence
  CIITA targeting sequence
cuccuuagccccaccuguuc

SEQ ID NO: 42981 - RNA, 20 nt, Artificial Sequence
  CIITA targeting sequence
uuagccccaccuguucccag

SEQ ID NO: 42982 - RNA, 20 nt, Artificial Sequence
  CIITA targeting sequence
cagguagaaaccaauaccgg

SEQ ID NO: 42983 - RNA, 20 nt, Artificial Sequence
  CIITA targeting sequence
accugggaacagguggggcu

SEQ ID NO: 42984 - RNA, 20 nt, Artificial Sequence
  CIITA targeting sequence
cugccgguauugguuucuac

SEQ ID NO: 42985 - RNA, 20 nt, Artificial Sequence
  CIITA targeting sequence
caaggcuaggggccuucuga

SEQ ID NO: 42986 - RNA, 20 nt, Artificial Sequence
  CIITA targeting sequence
aggcuaggggccuucugaaa

SEQ ID NO: 42987 - RNA, 20 nt, Artificial Sequence
  CIITA targeting sequence
gaaagcagcagcacuuuucc

SEQ ID NO: 42988 - RNA, 20 nt, Artificial Sequence
  CIITA targeting sequence
gaaggccccuagccuugaga

SEQ ID NO: 42989 - RNA, 20 nt, Artificial Sequence
  CIITA targeting sequence
uccuucaaagaccuugccuu

SEQ ID NO: 42990 - RNA, 20 nt, Artificial Sequence
  CIITA targeting sequence
uucaaagaccuugccuucua

SEQ ID NO: 42991 - RNA, 20 nt, Artificial Sequence
  CIITA targeting sequence
aagaccuugccuucuagaaa

SEQ ID NO: 42992 - RNA, 20 nt, Artificial Sequence
  CIITA targeting sequence
uugaaggaggaaaagugcug

SEQ ID NO: 42993 - RNA, 20 nt, Artificial Sequence
  CIITA targeting sequence
agaaacccauugcucauucc

SEQ ID NO: 42994 - RNA, 20 nt, Artificial Sequence
  CIITA targeting sequence
agaaggcaaggucuuugaag

SEQ ID NO: 42995 - RNA, 20 nt, Artificial Sequence
  CIITA targeting sequence
uuccuuucuccauguaccaa

SEQ ID NO: 42996 - RNA, 20 nt, Artificial Sequence
  CIITA targeting sequence
uuucuccauguaccaaaaaa

SEQ ID NO: 42997 - RNA, 20 nt, Artificial Sequence
  CIITA targeting sequence
ccauguaccaaaaaaucaau

SEQ ID NO: 42998 - RNA, 20 nt, Artificial Sequence
  CIITA targeting sequence
auguaccaaaaaaucaauua

SEQ ID NO: 42999 - RNA, 20 nt, Artificial Sequence
  CIITA targeting sequence
auuaaaguggcuaaagacag

SEQ ID NO: 43000 - RNA, 20 nt, Artificial Sequence
  CIITA targeting sequence
uuagccacuuuaauugauuu

SEQ ID NO: 43001 - RNA, 20 nt, Artificial Sequence
  CIITA targeting sequence
gucuuuagccacuuuaauug

SEQ ID NO: 43002 - RNA, 20 nt, Artificial Sequence
  CIITA targeting sequence
cccuccccuacucacgcagc

SEQ ID NO: 43003 - RNA, 20 nt, Artificial Sequence
  CIITA targeting sequence
ccuacucacgcagccauucu

SEQ ID NO: 43004 - RNA, 20 nt, Artificial Sequence
  CIITA targeting sequence
cgcagccauucugauccucc

SEQ ID NO: 43005 - RNA, 20 nt, Artificial Sequence
  CIITA targeting sequence
gauccuccacgcuggugaca

SEQ ID NO: 43006 - RNA, 20 nt, Artificial Sequence
  CIITA targeting sequence
gaauggcugcgugaguaggg

SEQ ID NO: 43007 - RNA, 20 nt, Artificial Sequence
  CIITA targeting sequence
uccacgcuggugacaggcua

SEQ ID NO: 43008 - RNA, 20 nt, Artificial Sequence
  CIITA targeting sequence
acgcuggugacaggcuaugu

SEQ ID NO: 43009 - RNA, 20 nt, Artificial Sequence
  CIITA targeting sequence
ccagcguggaggaucagaau

SEQ ID NO: 43010 - RNA, 20 nt, Artificial Sequence
  CIITA targeting sequence
ugccacauagccugucacca

SEQ ID NO: 43011 - RNA, 20 nt, Artificial Sequence
  CIITA targeting sequence
cuaccuuaucucagaaugaa

SEQ ID NO: 43012 - RNA, 20 nt, Artificial Sequence
  CIITA targeting sequence
accuuaucucagaaugaagg

SEQ ID NO: 43013 - RNA, 20 nt, Artificial Sequence
  CIITA targeting sequence
cagaaugaaggcauggcugg

SEQ ID NO: 43014 - RNA, 20 nt, Artificial Sequence
  CIITA targeting sequence
gaaugaaggcauggcugggg

SEQ ID NO: 43015 - RNA, 20 nt, Artificial Sequence
  CIITA targeting sequence
gagauaagguagagacccuc

SEQ ID NO: 43016 - RNA, 20 nt, Artificial Sequence
  CIITA targeting sequence
uucugagauaagguagagac

SEQ ID NO: 43017 - RNA, 20 nt, Artificial Sequence
  CIITA targeting sequence
ggcugucuccugguggccgg

SEQ ID NO: 43018 - RNA, 20 nt, Artificial Sequence
  CIITA targeting sequence
ccugguggccggaaggagac

SEQ ID NO: 43019 - RNA, 20 nt, Artificial Sequence
  CIITA targeting sequence
ugguggccggaaggagacag

SEQ ID NO: 43020 - RNA, 20 nt, Artificial Sequence
  CIITA targeting sequence
ggccaccaggagacagccag

SEQ ID NO: 43021 - RNA, 20 nt, Artificial Sequence
  CIITA targeting sequence
uuccggccaccaggagacag

SEQ ID NO: 43022 - RNA, 20 nt, Artificial Sequence
  CIITA targeting sequence
ccuuccggccaccaggagac

SEQ ID NO: 43023 - RNA, 20 nt, Artificial Sequence
  CIITA targeting sequence
gucuccuuccggccaccagg

SEQ ID NO: 43024 - RNA, 20 nt, Artificial Sequence
  CIITA targeting sequence
uuugccgucugucuccuucc

SEQ ID NO: 43025 - RNA, 20 nt, Artificial Sequence
  CIITA targeting sequence
ccuuugccgucugucuccuu

SEQ ID NO: 43026 - RNA, 20 nt, Artificial Sequence
  CIITA targeting sequence
cugcacagguccaugucccu

SEQ ID NO: 43027 - RNA, 20 nt, Artificial Sequence
  CIITA targeting sequence
gcacagguccaugucccuga

SEQ ID NO: 43028 - RNA, 20 nt, Artificial Sequence
  CIITA targeting sequence
augucccugaggaaagccaa

SEQ ID NO: 43029 - RNA, 20 nt, Artificial Sequence
  CIITA targeting sequence
cugaggaaagccaacgucac

SEQ ID NO: 43030 - RNA, 20 nt, Artificial Sequence
  CIITA targeting sequence
gggacauggaccugugcaga

SEQ ID NO: 43031 - RNA, 20 nt, Artificial Sequence
  CIITA targeting sequence
ucagggacauggaccugugc

SEQ ID NO: 43032 - RNA, 20 nt, Artificial Sequence
  CIITA targeting sequence
cagagaaaugaugaccacuu

SEQ ID NO: 43033 - RNA, 20 nt, Artificial Sequence
  CIITA targeting sequence
gugacguuggcuuuccucag

SEQ ID NO: 43034 - RNA, 20 nt, Artificial Sequence
  CIITA targeting sequence
cugugacguuggcuuuccuc

SEQ ID NO: 43035 - RNA, 20 nt, Artificial Sequence
  CIITA targeting sequence
uuucucugugacguuggcuu

SEQ ID NO: 43036 - RNA, 20 nt, Artificial Sequence
  CIITA targeting sequence
ucauuucucugugacguugg

SEQ ID NO: 43037 - RNA, 20 nt, Artificial Sequence
  CIITA targeting sequence
caaaccuggcuucggauuug

SEQ ID NO: 43038 - RNA, 20 nt, Artificial Sequence
  CIITA targeting sequence
aaccuggcuucggauuugca

SEQ ID NO: 43039 - RNA, 20 nt, Artificial Sequence
  CIITA targeting sequence
gauuugcacguuggcugcca

SEQ ID NO: 43040 - RNA, 20 nt, Artificial Sequence
  CIITA targeting sequence
gaagccagguuugagaaagu

SEQ ID NO: 43041 - RNA, 20 nt, Artificial Sequence
  CIITA targeting sequence
gcuuuggcagccaacgugca

SEQ ID NO: 43042 - RNA, 20 nt, Artificial Sequence
  CIITA targeting sequence
gcagcgggcuuugugaagau

SEQ ID NO: 43043 - RNA, 20 nt, Artificial Sequence
  CIITA targeting sequence
caaagcccgcugcugaucag

SEQ ID NO: 43044 - RNA, 20 nt, Artificial Sequence
  CIITA targeting sequence
ucacaaagcccgcugcugau

SEQ ID NO: 43045 - RNA, 20 nt, Artificial Sequence
  CIITA targeting sequence
accacgugccuccagcuggu

SEQ ID NO: 43046 - RNA, 20 nt, Artificial Sequence
  CIITA targeting sequence
agcuggucacgcccaagacu

SEQ ID NO: 43047 - RNA, 20 nt, Artificial Sequence
  CIITA targeting sequence
cgcccaagacucccugagcc

SEQ ID NO: 43048 - RNA, 20 nt, Artificial Sequence
  CIITA targeting sequence
ugggcgugaccagcuggagg

SEQ ID NO: 43049 - RNA, 20 nt, Artificial Sequence
  CIITA targeting sequence
cugagcccucuggaagggca

SEQ ID NO: 43050 - RNA, 20 nt, Artificial Sequence
  CIITA targeting sequence
gggagucuugggcgugacca

SEQ ID NO: 43051 - RNA, 20 nt, Artificial Sequence
  CIITA targeting sequence
ggaagggcagcacuugccca

SEQ ID NO: 43052 - RNA, 20 nt, Artificial Sequence
  CIITA targeting sequence
agagggcucagggagucuug

SEQ ID NO: 43053 - RNA, 20 nt, Artificial Sequence
  CIITA targeting sequence
cuccagguccugccacaucc

SEQ ID NO: 43054 - RNA, 20 nt, Artificial Sequence
  CIITA targeting sequence
agguccugccacauccaaga

SEQ ID NO: 43055 - RNA, 20 nt, Artificial Sequence
  CIITA targeting sequence
ugccacauccaagaaccacc

SEQ ID NO: 43056 - RNA, 20 nt, Artificial Sequence
  CIITA targeting sequence
aagaaccaccuggacuauua

SEQ ID NO: 43057 - RNA, 20 nt, Artificial Sequence
  CIITA targeting sequence
uggauguggcaggaccugga

SEQ ID NO: 43058 - RNA, 20 nt, Artificial Sequence
  CIITA targeting sequence
aggugguucuuggauguggc

SEQ ID NO: 43059 - RNA, 20 nt, Artificial Sequence
  CIITA targeting sequence
aauuuuuuaauaagaucauu

SEQ ID NO: 43060 - RNA, 20 nt, Artificial Sequence
  CIITA targeting sequence
uauuaaaaaauuggaguuua

SEQ ID NO: 43061 - RNA, 20 nt, Artificial Sequence
  CIITA targeting sequence
uuuaugucaccauauaacac

SEQ ID NO: 43062 - RNA, 20 nt, Artificial Sequence
  CIITA targeting sequence
ccauauaacacccaaagcag

SEQ ID NO: 43063 - RNA, 20 nt, Artificial Sequence
  CIITA targeting sequence
acugcuuuggguguuauaug

SEQ ID NO: 43064 - RNA, 20 nt, Artificial Sequence
  CIITA targeting sequence
uacacagaaggcaaugcuaa

SEQ ID NO: 43065 - RNA, 20 nt, Artificial Sequence
  CIITA targeting sequence
guguaugacaaauucuacug

SEQ ID NO: 43066 - RNA, 20 nt, Artificial Sequence
  CIITA targeting sequence
uuguauuuuuagcauugccu

SEQ ID NO: 43067 - RNA, 20 nt, Artificial Sequence
  CIITA targeting sequence
auuuucauuguauuuuuagc

SEQ ID NO: 43068 - RNA, 20 nt, Artificial Sequence
  CIITA targeting sequence
ugguuccauuuucauuguau

SEQ ID NO: 43069 - RNA, 20 nt, Artificial Sequence
  CIITA targeting sequence
agcuugauacccuuggccug

SEQ ID NO: 43070 - RNA, 20 nt, Artificial Sequence
  CIITA targeting sequence
agcuagacuuccugguucca

SEQ ID NO: 43071 - RNA, 20 nt, Artificial Sequence
  CIITA targeting sequence
guuauacaggccaaggguau

SEQ ID NO: 43072 - RNA, 20 nt, Artificial Sequence
  CIITA targeting sequence
gggggugucggggcccugag

SEQ ID NO: 43073 - RNA, 20 nt, Artificial Sequence
  CIITA targeting sequence
gggcccugagagcugaucug

SEQ ID NO: 43074 - RNA, 20 nt, Artificial Sequence
  CIITA targeting sequence
gggccccgacacccccugag

SEQ ID NO: 43075 - RNA, 20 nt, Artificial Sequence
  CIITA targeting sequence
cagggccccgacacccccug

SEQ ID NO: 43076 - RNA, 20 nt, Artificial Sequence
  CIITA targeting sequence
gcucucagggccccgacacc

SEQ ID NO: 43077 - RNA, 20 nt, Artificial Sequence
  CIITA targeting sequence
gauccgcugcugcguauuca

SEQ ID NO: 43078 - RNA, 20 nt, Artificial Sequence
  CIITA targeting sequence
gaucagcucucagggccccg

SEQ ID NO: 43079 - RNA, 20 nt, Artificial Sequence
  CIITA targeting sequence
gcugcugcguauucacuacc

SEQ ID NO: 43080 - RNA, 20 nt, Artificial Sequence
  CIITA targeting sequence
cuaccgcccugggacgccuc

SEQ ID NO: 43081 - RNA, 20 nt, Artificial Sequence
  CIITA targeting sequence
cagggcgguagugaauacgc

SEQ ID NO: 43082 - RNA, 20 nt, Artificial Sequence
  CIITA targeting sequence
agcagaccaccucacugggg

SEQ ID NO: 43083 - RNA, 20 nt, Artificial Sequence
  CIITA targeting sequence
gcuggaggcgucccagggcg

SEQ ID NO: 43084 - RNA, 20 nt, Artificial Sequence
  CIITA targeting sequence
cugggggaaacaucaggaca

SEQ ID NO: 43085 - RNA, 20 nt, Artificial Sequence
  CIITA targeting sequence
cccagugagguggucugcug

SEQ ID NO: 43086 - RNA, 20 nt, Artificial Sequence
  CIITA targeting sequence
ggacagcguggccaggagcc

SEQ ID NO: 43087 - RNA, 20 nt, Artificial Sequence
  CIITA targeting sequence
ugauguuucccccagugagg

SEQ ID NO: 43088 - RNA, 20 nt, Artificial Sequence
  CIITA targeting sequence
uggccacgcuguccugaugu

SEQ ID NO: 43089 - RNA, 20 nt, Artificial Sequence
  CIITA targeting sequence
uagauggguaucugagauga

SEQ ID NO: 43090 - RNA, 20 nt, Artificial Sequence
  CIITA targeting sequence
augagguggcagcauugggc

SEQ ID NO: 43091 - RNA, 20 nt, Artificial Sequence
  CIITA targeting sequence
gagaugagucaucgaacuuc

SEQ ID NO: 43092 - RNA, 20 nt, Artificial Sequence
  CIITA targeting sequence
gauacccaucuaugaggugg

SEQ ID NO: 43093 - RNA, 20 nt, Artificial Sequence
  CIITA targeting sequence
cagauacccaucuaugaggu

SEQ ID NO: 43094 - RNA, 20 nt, Artificial Sequence
  CIITA targeting sequence
ucucagauacccaucuauga

SEQ ID NO: 43095 - RNA, 20 nt, Artificial Sequence
  CIITA targeting sequence
ucgaacuucugcaagccuca

SEQ ID NO: 43096 - RNA, 20 nt, Artificial Sequence
  CIITA targeting sequence
aacuucugcaagccucaguu

SEQ ID NO: 43097 - RNA, 20 nt, Artificial Sequence
  CIITA targeting sequence
augacucaucucagauaccc

SEQ ID NO: 43098 - RNA, 20 nt, Artificial Sequence
  CIITA targeting sequence
gcaagccucaguuuccuccc

SEQ ID NO: 43099 - RNA, 20 nt, Artificial Sequence
  CIITA targeting sequence
guuuccucccuggucuaaug

SEQ ID NO: 43100 - RNA, 20 nt, Artificial Sequence
  CIITA targeting sequence
ucccuggucuaauggaaccc

SEQ ID NO: 43101 - RNA, 20 nt, Artificial Sequence
  CIITA targeting sequence
cuggucuaauggaacccucc

SEQ ID NO: 43102 - RNA, 20 nt, Artificial Sequence
  CIITA targeting sequence
aauggaacccuccuuggcgg

SEQ ID NO: 43103 - RNA, 20 nt, Artificial Sequence
  CIITA targeting sequence
auuagaccagggaggaaacu

SEQ ID NO: 43104 - RNA, 20 nt, Artificial Sequence
  CIITA targeting sequence
uuggcggcuucacaggguga

SEQ ID NO: 43105 - RNA, 20 nt, Artificial Sequence
  CIITA targeting sequence
cagggugaugcuuggggcag

SEQ ID NO: 43106 - RNA, 20 nt, Artificial Sequence
  CIITA targeting sequence
cccugugaagccgccaagga

SEQ ID NO: 43107 - RNA, 20 nt, Artificial Sequence
  CIITA targeting sequence
ccugccccaagcaucacccu

SEQ ID NO: 43108 - RNA, 20 nt, Artificial Sequence
  CIITA targeting sequence
aucaccugccccaagcauca

SEQ ID NO: 43109 - RNA, 20 nt, Artificial Sequence
  CIITA targeting sequence
ccaucaccugccccaagcau

SEQ ID NO: 43110 - RNA, 20 nt, Artificial Sequence
  CIITA targeting sequence
cacaucuccaucaccugccc

SEQ ID NO: 43111 - RNA, 20 nt, Artificial Sequence
  CIITA targeting sequence
cccacaucuccaucaccugc

SEQ ID NO: 43112 - RNA, 20 nt, Artificial Sequence
  CIITA targeting sequence
uggcaaggggcuuggcuggg

SEQ ID NO: 43113 - RNA, 20 nt, Artificial Sequence
  CIITA targeting sequence
cuccuggcaaggggcuuggc

SEQ ID NO: 43114 - RNA, 20 nt, Artificial Sequence
  CIITA targeting sequence
cagaaaugaagccuuacccu

SEQ ID NO: 43115 - RNA, 20 nt, Artificial Sequence
  CIITA targeting sequence
gggagucccuccuggcaagg

SEQ ID NO: 43116 - RNA, 20 nt, Artificial Sequence
  CIITA targeting sequence
uuucugggagucccuccugg

SEQ ID NO: 43117 - RNA, 20 nt, Artificial Sequence
  CIITA targeting sequence
aggguaaggcuucauuucug

SEQ ID NO: 43118 - RNA, 20 nt, Artificial Sequence
  CIITA targeting sequence
cucaaggguaaggcuucauu

SEQ ID NO: 43119 - RNA, 20 nt, Artificial Sequence
  CIITA targeting sequence
ccgccacuccaagcuugggg

SEQ ID NO: 43120 - RNA, 20 nt, Artificial Sequence
  CIITA targeting sequence
aagcuuggggccugggaugg

SEQ ID NO: 43121 - RNA, 20 nt, Artificial Sequence
  CIITA targeting sequence
caggccccaagcuuggagug

SEQ ID NO: 43122 - RNA, 20 nt, Artificial Sequence
  CIITA targeting sequence
cagcugccaucccaggcccc

SEQ ID NO: 43123 - RNA, 20 nt, Artificial Sequence
  CIITA targeting sequence
ggggacucgcuggguaccaa

SEQ ID NO: 43124 - RNA, 20 nt, Artificial Sequence
  CIITA targeting sequence
ccagauggugcuggugcccu

SEQ ID NO: 43125 - RNA, 20 nt, Artificial Sequence
  CIITA targeting sequence
cuggguaccaauuaucaccg

SEQ ID NO: 43126 - RNA, 20 nt, Artificial Sequence
  CIITA targeting sequence
ccgcccuugggcuacuucaa

SEQ ID NO: 43127 - RNA, 20 nt, Artificial Sequence
  CIITA targeting sequence
aaggcugcccacacagacac

SEQ ID NO: 43128 - RNA, 20 nt, Artificial Sequence
  CIITA targeting sequence
gugugggcagccuuugaagu

SEQ ID NO: 43129 - RNA, 20 nt, Artificial Sequence
  CIITA targeting sequence
uugguaaccaguccucagga

SEQ ID NO: 43130 - RNA, 20 nt, Artificial Sequence
  CIITA targeting sequence
ucaggaggaagggcacccaa

SEQ ID NO: 43131 - RNA, 20 nt, Artificial Sequence
  CIITA targeting sequence
ggaggaagggcacccaagga

SEQ ID NO: 43132 - RNA, 20 nt, Artificial Sequence
  CIITA targeting sequence
ugaggacugguuaccaagga

SEQ ID NO: 43133 - RNA, 20 nt, Artificial Sequence
  CIITA targeting sequence
uccugaggacugguuaccaa

SEQ ID NO: 43134 - RNA, 20 nt, Artificial Sequence
  CIITA targeting sequence
uugggugcccuuccuccuga

SEQ ID NO: 43135 - RNA, 20 nt, Artificial Sequence
  CIITA targeting sequence
cccuuuccuugggugcccuu

SEQ ID NO: 43136 - RNA, 20 nt, Artificial Sequence
  CIITA targeting sequence
ugggcuagagccccuucagg

SEQ ID NO: 43137 - RNA, 20 nt, Artificial Sequence
  CIITA targeting sequence
agcccaggaagccuuccccc

SEQ ID NO: 43138 - RNA, 20 nt, Artificial Sequence
  CIITA targeting sequence
gggucugacacgccauugac

SEQ ID NO: 43139 - RNA, 20 nt, Artificial Sequence
  CIITA targeting sequence
gacacgccauugacacugac

SEQ ID NO: 43140 - RNA, 20 nt, Artificial Sequence
  CIITA targeting sequence
gacccugaaggggcucuagc

SEQ ID NO: 43141 - RNA, 20 nt, Artificial Sequence
  CIITA targeting sequence
auggcgugucagacccugaa

SEQ ID NO: 43142 - RNA, 20 nt, Artificial Sequence
  CIITA targeting sequence
gugucaauggcgugucagac

SEQ ID NO: 43143 - RNA, 20 nt, Artificial Sequence
  CIITA targeting sequence
uucauuaagcaagcaccaac

SEQ ID NO: 43144 - RNA, 20 nt, Artificial Sequence
  CIITA targeting sequence
uuaagcaagcaccaacuaua

SEQ ID NO: 43145 - RNA, 20 nt, Artificial Sequence
  CIITA targeting sequence
uucacuaucccaaucuaauu

SEQ ID NO: 43146 - RNA, 20 nt, Artificial Sequence
  CIITA targeting sequence
cuaucccaaucuaauuugca

SEQ ID NO: 43147 - RNA, 20 nt, Artificial Sequence
  CIITA targeting sequence
caaucuaauuugcacaagcc

SEQ ID NO: 43148 - RNA, 20 nt, Artificial Sequence
  CIITA targeting sequence
aauuugcacaagcccuuagg

SEQ ID NO: 43149 - RNA, 20 nt, Artificial Sequence
  CIITA targeting sequence
cuguuuuacagagaaggaaa

SEQ ID NO: 43150 - RNA, 20 nt, Artificial Sequence
  CIITA targeting sequence
guaaaacagggauaauagua

SEQ ID NO: 43151 - RNA, 20 nt, Artificial Sequence
  CIITA targeting sequence
cuguaaaacagggauaauag

SEQ ID NO: 43152 - RNA, 20 nt, Artificial Sequence
  CIITA targeting sequence
uucucuguaaaacagggaua

SEQ ID NO: 43153 - RNA, 20 nt, Artificial Sequence
  CIITA targeting sequence
guuuccuucucuguaaaaca

SEQ ID NO: 43154 - RNA, 20 nt, Artificial Sequence
  CIITA targeting sequence
uaagccucgguuuccuucuc

SEQ ID NO: 43155 - RNA, 20 nt, Artificial Sequence
  CIITA targeting sequence
ccuaagccucgguuuccuuc

SEQ ID NO: 43156 - RNA, 20 nt, Artificial Sequence
  CIITA targeting sequence
ucuccuaagccucgguuucc

SEQ ID NO: 43157 - RNA, 20 nt, Artificial Sequence
  CIITA targeting sequence
gagguguugguggagcuggg

SEQ ID NO: 43158 - RNA, 20 nt, Artificial Sequence
  CIITA targeting sequence
gacuucaucuccuaagccuc

SEQ ID NO: 43159 - RNA, 20 nt, Artificial Sequence
  CIITA targeting sequence
accaacaccucagacuucau

SEQ ID NO: 43160 - RNA, 20 nt, Artificial Sequence
  CIITA targeting sequence
cagcuccaccaacaccucag

SEQ ID NO: 43161 - RNA, 20 nt, Artificial Sequence
  CIITA targeting sequence
aacugcaaagcauguaagua

SEQ ID NO: 43162 - RNA, 20 nt, Artificial Sequence
  CIITA targeting sequence
aaaauuguuacuuacaugcu

SEQ ID NO: 43163 - RNA, 20 nt, Artificial Sequence
  CIITA targeting sequence
guauacccucuaaaauuguu

SEQ ID NO: 43164 - RNA, 20 nt, Artificial Sequence
  CIITA targeting sequence
ccuccguauacccucuaaaa

SEQ ID NO: 43165 - RNA, 20 nt, Artificial Sequence
  CIITA targeting sequence
uuguuacuuagggucaccuc

SEQ ID NO: 43166 - RNA, 20 nt, Artificial Sequence
  CIITA targeting sequence
cauauagugagcaagcaauu

SEQ ID NO: 43167 - RNA, 20 nt, Artificial Sequence
  CIITA targeting sequence
cuauaugugauuccuuguua

SEQ ID NO: 43168 - RNA, 20 nt, Artificial Sequence
  CIITA targeting sequence
guuuuuggucaauccuuaug

SEQ ID NO: 43169 - RNA, 20 nt, Artificial Sequence
  CIITA targeting sequence
auccuuaugauuauuuagag

SEQ ID NO: 43170 - RNA, 20 nt, Artificial Sequence
  CIITA targeting sequence
uuaugauuauuuagaggaga

SEQ ID NO: 43171 - RNA, 20 nt, Artificial Sequence
  CIITA targeting sequence
uaaggauugaccaaaaacug

SEQ ID NO: 43172 - RNA, 20 nt, Artificial Sequence
  CIITA targeting sequence
aaauaaucauaaggauugac

SEQ ID NO: 43173 - RNA, 20 nt, Artificial Sequence
  CIITA targeting sequence
ucuaaauaaucauaaggauu

SEQ ID NO: 43174 - RNA, 20 nt, Artificial Sequence
  CIITA targeting sequence
ccucuaaauaaucauaagga

SEQ ID NO: 43175 - RNA, 20 nt, Artificial Sequence
  CIITA targeting sequence
guuuggugcugguauaucuu

SEQ ID NO: 43176 - RNA, 20 nt, Artificial Sequence
  CIITA targeting sequence
uauguuuaucacccgacagu

SEQ ID NO: 43177 - RNA, 20 nt, Artificial Sequence
  CIITA targeting sequence
cccgacaguuguuaaucucu

SEQ ID NO: 43178 - RNA, 20 nt, Artificial Sequence
  CIITA targeting sequence
ggugauaaacauaagauaua

SEQ ID NO: 43179 - RNA, 20 nt, Artificial Sequence
  CIITA targeting sequence
cuuuuuaacaaagaauacag

SEQ ID NO: 43180 - RNA, 20 nt, Artificial Sequence
  CIITA targeting sequence
uuuuaacaaagaauacaggc

SEQ ID NO: 43181 - RNA, 20 nt, Artificial Sequence
  CIITA targeting sequence
uuguuaaaaagagauuaaca

SEQ ID NO: 43182 - RNA, 20 nt, Artificial Sequence
  CIITA targeting sequence
cagggccuuggccuguauuc

SEQ ID NO: 43183 - RNA, 20 nt, Artificial Sequence
  CIITA targeting sequence
uuaacuuuuggccaaauacc

SEQ ID NO: 43184 - RNA, 20 nt, Artificial Sequence
  CIITA targeting sequence
augccaagcgaugaugauuu

SEQ ID NO: 43185 - RNA, 20 nt, Artificial Sequence
  CIITA targeting sequence
cuuggcauggauaaaaacac

SEQ ID NO: 43186 - RNA, 20 nt, Artificial Sequence
  CIITA targeting sequence
ucgcuuggcauggauaaaaa

SEQ ID NO: 43187 - RNA, 20 nt, Artificial Sequence
  CIITA targeting sequence
ucaucgcuuggcauggauaa

SEQ ID NO: 43188 - RNA, 20 nt, Artificial Sequence
  CIITA targeting sequence
cuuuagugacagacauuuuu

SEQ ID NO: 43189 - RNA, 20 nt, Artificial Sequence
  CIITA targeting sequence
uuagugacagacauuuuuua

SEQ ID NO: 43190 - RNA, 20 nt, Artificial Sequence
  CIITA targeting sequence
cuaaagagaaaaucaucauc

SEQ ID NO: 43191 - RNA, 20 nt, Artificial Sequence
  CIITA targeting sequence
gucacuaaagagaaaaucau

SEQ ID NO: 43192 - RNA, 20 nt, Artificial Sequence
  CIITA targeting sequence
cauaaaaaaguaguuuuaca

SEQ ID NO: 43193 - RNA, 20 nt, Artificial Sequence
  CIITA targeting sequence
guaaaacuacuuuuuuaugu

SEQ ID NO: 43194 - RNA, 20 nt, Artificial Sequence
  CIITA targeting sequence
ucuguaaaacuacuuuuuua

SEQ ID NO: 43195 - RNA, 20 nt, Artificial Sequence
  CIITA targeting sequence
ucuuaaacugcaaauuauaa

SEQ ID NO: 43196 - RNA, 20 nt, Artificial Sequence
  CIITA targeting sequence
uaaacugcaaauuauaaagg

SEQ ID NO: 43197 - RNA, 20 nt, Artificial Sequence
  CIITA targeting sequence
cuuuauaauuugcaguuuaa

SEQ ID NO: 43198 - RNA, 20 nt, Artificial Sequence
  CIITA targeting sequence
aguuacuauuauucccuuua

SEQ ID NO: 43199 - RNA, 20 nt, Artificial Sequence
  CIITA targeting sequence
acugucaaguuacuauuauu

SEQ ID NO: 43200 - RNA, 20 nt, Artificial Sequence
  CIITA targeting sequence
ccacugucaaguuacuauua

SEQ ID NO: 43201 - RNA, 20 nt, Artificial Sequence
  CIITA targeting sequence
cuccacugucaaguuacuau

SEQ ID NO: 43202 - RNA, 20 nt, Artificial Sequence
  CIITA targeting sequence
gccaggucucuccacuguca

SEQ ID NO: 43203 - RNA, 20 nt, Artificial Sequence
  CIITA targeting sequence
ccaacugaucaaaguuaaca

SEQ ID NO: 43204 - RNA, 20 nt, Artificial Sequence
  CIITA targeting sequence
guuggugaagguggugucug

SEQ ID NO: 43205 - RNA, 20 nt, Artificial Sequence
  CIITA targeting sequence
aaguuaacaucgccagaaag

SEQ ID NO: 43206 - RNA, 20 nt, Artificial Sequence
  CIITA targeting sequence
ccagaaaggggacagauggc

SEQ ID NO: 43207 - RNA, 20 nt, Artificial Sequence
  CIITA targeting sequence
ggcgauguuaacuuugauca

SEQ ID NO: 43208 - RNA, 20 nt, Artificial Sequence
  CIITA targeting sequence
ccuuucuggcgauguuaacu

SEQ ID NO: 43209 - RNA, 20 nt, Artificial Sequence
  CIITA targeting sequence
guccccuuucuggcgauguu

SEQ ID NO: 43210 - RNA, 20 nt, Artificial Sequence
  CIITA targeting sequence
cgauaagaugcacugaagac

SEQ ID NO: 43211 - RNA, 20 nt, Artificial Sequence
  CIITA targeting sequence
auaagaugcacugaagacac

SEQ ID NO: 43212 - RNA, 20 nt, Artificial Sequence
  CIITA targeting sequence
agaggcacaugccaucuguc

SEQ ID NO: 43213 - RNA, 20 nt, Artificial Sequence
  CIITA targeting sequence
uaucgagaggcacaugccau

SEQ ID NO: 43214 - RNA, 20 nt, Artificial Sequence
  CIITA targeting sequence
gugcaucuuaucgagaggca

SEQ ID NO: 43215 - RNA, 20 nt, Artificial Sequence
  CIITA targeting sequence
ucagugcaucuuaucgagag

SEQ ID NO: 43216 - RNA, 20 nt, Artificial Sequence
  CIITA targeting sequence
cuucugcaauauuccugcca

SEQ ID NO: 43217 - RNA, 20 nt, Artificial Sequence
  CIITA targeting sequence
gcaauauuccugccaagaau

SEQ ID NO: 43218 - RNA, 20 nt, Artificial Sequence
  CIITA targeting sequence
ugccaagaaugccucaucug

SEQ ID NO: 43219 - RNA, 20 nt, Artificial Sequence
  CIITA targeting sequence
uggcaggaauauugcagaag

SEQ ID NO: 43220 - RNA, 20 nt, Artificial Sequence
  CIITA targeting sequence
ucugaaucuaaucucgagua

SEQ ID NO: 43221 - RNA, 20 nt, Artificial Sequence
  CIITA targeting sequence
gaaucuaaucucgaguauaa

SEQ ID NO: 43222 - RNA, 20 nt, Artificial Sequence
  CIITA targeting sequence
gaugaggcauucuuggcagg

SEQ ID NO: 43223 - RNA, 20 nt, Artificial Sequence
  CIITA targeting sequence
aaucucgaguauaaccauca

SEQ ID NO: 43224 - RNA, 20 nt, Artificial Sequence
  CIITA targeting sequence
cgaguauaaccaucagacaa

SEQ ID NO: 43225 - RNA, 20 nt, Artificial Sequence
  CIITA targeting sequence
aguauaaccaucagacaaac

SEQ ID NO: 43226 - RNA, 20 nt, Artificial Sequence
  CIITA targeting sequence
agauuagauucagaugaggc

SEQ ID NO: 43227 - RNA, 20 nt, Artificial Sequence
  CIITA targeting sequence
gacaaacccaaauugagaga

SEQ ID NO: 43228 - RNA, 20 nt, Artificial Sequence
  CIITA targeting sequence
gaugguuauacucgagauua

SEQ ID NO: 43229 - RNA, 20 nt, Artificial Sequence
  CIITA targeting sequence
auuuggguuugucugauggu

SEQ ID NO: 43230 - RNA, 20 nt, Artificial Sequence
  CIITA targeting sequence
caauuuggguuugucugaug

SEQ ID NO: 43231 - RNA, 20 nt, Artificial Sequence
  CIITA targeting sequence
cucaauuuggguuugucuga

SEQ ID NO: 43232 - RNA, 20 nt, Artificial Sequence
  CIITA targeting sequence
gcuuaauaugucaaugucac

SEQ ID NO: 43233 - RNA, 20 nt, Artificial Sequence
  CIITA targeting sequence
augucacaagagagaaagac

SEQ ID NO: 43234 - RNA, 20 nt, Artificial Sequence
  CIITA targeting sequence
caagagagaaagacagacug

SEQ ID NO: 43235 - RNA, 20 nt, Artificial Sequence
  CIITA targeting sequence
ugugacauugacauauuaag

SEQ ID NO: 43236 - RNA, 20 nt, Artificial Sequence
  CIITA targeting sequence
cuugugacauugacauauua

SEQ ID NO: 43237 - RNA, 20 nt, Artificial Sequence
  CIITA targeting sequence
cucuugugacauugacauau

SEQ ID NO: 43238 - RNA, 20 nt, Artificial Sequence
  CIITA targeting sequence
uucucucuugugacauugac

SEQ ID NO: 43239 - RNA, 20 nt, Artificial Sequence
  CIITA targeting sequence
gucuuucucucuugugacau

SEQ ID NO: 43240 - RNA, 20 nt, Artificial Sequence
  CIITA targeting sequence
gucugucuuucucucuugug

SEQ ID NO: 43241 - RNA, 20 nt, Artificial Sequence
  CIITA targeting sequence
ucagucugucuuucucucuu

SEQ ID NO: 43242 - RNA, 20 nt, Artificial Sequence
  CIITA targeting sequence
gcucuucagucugucuuucu

SEQ ID NO: 43243 - RNA, 20 nt, Artificial Sequence
  CIITA targeting sequence
agacugaagaaggcucgaga

SEQ ID NO: 43244 - RNA, 20 nt, Artificial Sequence
  CIITA targeting sequence
ggaucagcucuucagucugu

SEQ ID NO: 43245 - RNA, 20 nt, Artificial Sequence
  CIITA targeting sequence
gucuggaucagcucuucagu

SEQ ID NO: 43246 - RNA, 20 nt, Artificial Sequence
  CIITA targeting sequence
ucagucuggaucagcucuuc

SEQ ID NO: 43247 - RNA, 20 nt, Artificial Sequence
  CIITA targeting sequence
agauuaaugcaaaagcugau

SEQ ID NO: 43248 - RNA, 20 nt, Artificial Sequence
  CIITA targeting sequence
agccuucuucagucuggauc

SEQ ID NO: 43249 - RNA, 20 nt, Artificial Sequence
  CIITA targeting sequence
cgagccuucuucagucugga

SEQ ID NO: 43250 - RNA, 20 nt, Artificial Sequence
  CIITA targeting sequence
gcuuuugcauuaaucucgag

SEQ ID NO: 43251 - RNA, 20 nt, Artificial Sequence
  CIITA targeting sequence
gggauugcaucuuggaccuc

SEQ ID NO: 43252 - RNA, 20 nt, Artificial Sequence
  CIITA targeting sequence
cagaucagcuuuugcauuaa

SEQ ID NO: 43253 - RNA, 20 nt, Artificial Sequence
  CIITA targeting sequence
uggaccucaacucuccccuu

SEQ ID NO: 43254 - RNA, 20 nt, Artificial Sequence
  CIITA targeting sequence
aagaugcaaucccagaucag

SEQ ID NO: 43255 - RNA, 20 nt, Artificial Sequence
  CIITA targeting sequence
acucuccccuuuuuauuguu

SEQ ID NO: 43256 - RNA, 20 nt, Artificial Sequence
  CIITA targeting sequence
ccccuuuuuauuguuaaggg

SEQ ID NO: 43257 - RNA, 20 nt, Artificial Sequence
  CIITA targeting sequence
ccuuuuuauuguuaagggac

SEQ ID NO: 43258 - RNA, 20 nt, Artificial Sequence
  CIITA targeting sequence
cuuaacaauaaaaaggggag

SEQ ID NO: 43259 - RNA, 20 nt, Artificial Sequence
  CIITA targeting sequence
caguagugucccuuaacaau

SEQ ID NO: 43260 - RNA, 20 nt, Artificial Sequence
  CIITA targeting sequence
uuuugagacagggucucgcu

SEQ ID NO: 43261 - RNA, 20 nt, Artificial Sequence
  CIITA targeting sequence
aaacgaaaaaaaaaaaaaau

SEQ ID NO: 43262 - RNA, 20 nt, Artificial Sequence
  CIITA targeting sequence
caaaacgaaaaaaaaaaaaa

SEQ ID NO: 43263 - RNA, 20 nt, Artificial Sequence
  CIITA targeting sequence
cgcucagucacccaggcugg

SEQ ID NO: 43264 - RNA, 20 nt, Artificial Sequence
  CIITA targeting sequence
cucagucacccaggcuggag

SEQ ID NO: 43265 - RNA, 20 nt, Artificial Sequence
  CIITA targeting sequence
gucacccaggcuggagugca

SEQ ID NO: 43266 - RNA, 20 nt, Artificial Sequence
  CIITA targeting sequence
cccaggcuggagugcagugg

SEQ ID NO: 43267 - RNA, 20 nt, Artificial Sequence
  CIITA targeting sequence
agccugggugacugagcgag

SEQ ID NO: 43268 - RNA, 20 nt, Artificial Sequence
  CIITA targeting sequence
accacugcacuccagccugg

SEQ ID NO: 43269 - RNA, 20 nt, Artificial Sequence
  CIITA targeting sequence
cugcagccuugaacucccgg

SEQ ID NO: 43270 - RNA, 20 nt, Artificial Sequence
  CIITA targeting sequence
aggcugcagugaguuauuau

SEQ ID NO: 43271 - RNA, 20 nt, Artificial Sequence
  CIITA targeting sequence
cggacucaagcaauccuccu

SEQ ID NO: 43272 - RNA, 20 nt, Artificial Sequence
  CIITA targeting sequence
gggaguucaaggcugcagug

SEQ ID NO: 43273 - RNA, 20 nt, Artificial Sequence
  CIITA targeting sequence
agcaauccuccugccugagc

SEQ ID NO: 43274 - RNA, 20 nt, Artificial Sequence
  CIITA targeting sequence
uccugccugagccuuccgag

SEQ ID NO: 43275 - RNA, 20 nt, Artificial Sequence
  CIITA targeting sequence
ugccugagccuuccgaguaa

SEQ ID NO: 43276 - RNA, 20 nt, Artificial Sequence
  CIITA targeting sequence
ggcaggaggauugcuugagu

SEQ ID NO: 43277 - RNA, 20 nt, Artificial Sequence
  CIITA targeting sequence
gaguaacugggacuaugggc

SEQ ID NO: 43278 - RNA, 20 nt, Artificial Sequence
  CIITA targeting sequence
gaaggcucaggcaggaggau

SEQ ID NO: 43279 - RNA, 20 nt, Artificial Sequence
  CIITA targeting sequence
caguuacucggaaggcucag

SEQ ID NO: 43280 - RNA, 20 nt, Artificial Sequence
  CIITA targeting sequence
cuauuuuuuuuuuccuacuu

SEQ ID NO: 43281 - RNA, 20 nt, Artificial Sequence
  CIITA targeting sequence
uacuuuuuguagagacgggg

SEQ ID NO: 43282 - RNA, 20 nt, Artificial Sequence
  CIITA targeting sequence
acaaaaaguaggaaaaaaaa

SEQ ID NO: 43283 - RNA, 20 nt, Artificial Sequence
  CIITA targeting sequence
cuacaaaaaguaggaaaaaa

SEQ ID NO: 43284 - RNA, 20 nt, Artificial Sequence
  CIITA targeting sequence
cacuauguugcccaggcugg

SEQ ID NO: 43285 - RNA, 20 nt, Artificial Sequence
  CIITA targeting sequence
cuauguugcccaggcugguu

SEQ ID NO: 43286 - RNA, 20 nt, Artificial Sequence
  CIITA targeting sequence
aacucaagugauccuuccac

SEQ ID NO: 43287 - RNA, 20 nt, Artificial Sequence
  CIITA targeting sequence
agugauccuuccaccucagc

SEQ ID NO: 43288 - RNA, 20 nt, Artificial Sequence
  CIITA targeting sequence
cuugaguuugaaaccagccu

SEQ ID NO: 43289 - RNA, 20 nt, Artificial Sequence
  CIITA targeting sequence
uuccaccucagccucuauaa

SEQ ID NO: 43290 - RNA, 20 nt, Artificial Sequence
  CIITA targeting sequence
accucagccucuauaaaauu

SEQ ID NO: 43291 - RNA, 20 nt, Artificial Sequence
  CIITA targeting sequence
gccucuauaaaauuugaaua

SEQ ID NO: 43292 - RNA, 20 nt, Artificial Sequence
  CIITA targeting sequence
auaaaauuugaauaaaguug

SEQ ID NO: 43293 - RNA, 20 nt, Artificial Sequence
  CIITA targeting sequence
aauuuuauagaggcugaggu

SEQ ID NO: 43294 - RNA, 20 nt, Artificial Sequence
  CIITA targeting sequence
acaacuuuauucaaauuuua

SEQ ID NO: 43295 - RNA, 20 nt, Artificial Sequence
  CIITA targeting sequence
ucuacaacuuuauucaaauu

SEQ ID NO: 43296 - RNA, 20 nt, Artificial Sequence
  CIITA targeting sequence
caucuacaacuuuauucaaa

SEQ ID NO: 43297 - RNA, 20 nt, Artificial Sequence
  CIITA targeting sequence
uaggauuguauaguguauca

SEQ ID NO: 43298 - RNA, 20 nt, Artificial Sequence
  CIITA targeting sequence
uaugaccaaucucaucuaca

SEQ ID NO: 43299 - RNA, 20 nt, Artificial Sequence
  CIITA targeting sequence
auauuagauuugcugauuuu

SEQ ID NO: 43300 - RNA, 20 nt, Artificial Sequence
  CIITA targeting sequence
aauauugauacacuauacaa

SEQ ID NO: 43301 - RNA, 20 nt, Artificial Sequence
  CIITA targeting sequence
gcaaaucuaauauugauaca

SEQ ID NO: 43302 - RNA, 20 nt, Artificial Sequence
  CIITA targeting sequence
aaaucagcaaaucuaauauu

SEQ ID NO: 43303 - RNA, 20 nt, Artificial Sequence
  CIITA targeting sequence
uuguucuaaggaaauaaaua

SEQ ID NO: 43304 - RNA, 20 nt, Artificial Sequence
  CIITA targeting sequence
aaggaaauaaauacugaauu

SEQ ID NO: 43305 - RNA, 20 nt, Artificial Sequence
  CIITA targeting sequence
uuagaacaaggacaaauuug

SEQ ID NO: 43306 - RNA, 20 nt, Artificial Sequence
  CIITA targeting sequence
guauuuauuuccuuagaaca

SEQ ID NO: 43307 - RNA, 20 nt, Artificial Sequence
  CIITA targeting sequence
uaaauaauucaguauuuauu

SEQ ID NO: 43308 - RNA, 20 nt, Artificial Sequence
  CIITA targeting sequence
uuaugcaccuuuacuccuaa

SEQ ID NO: 43309 - RNA, 20 nt, Artificial Sequence
  CIITA targeting sequence
aaugcuuaugaaaauuacac

SEQ ID NO: 43310 - RNA, 20 nt, Artificial Sequence
  CIITA targeting sequence
uaagcauuugaaaauggguu

SEQ ID NO: 43311 - RNA, 20 nt, Artificial Sequence
  CIITA targeting sequence
guuuguauaugcaugccugu

SEQ ID NO: 43312 - RNA, 20 nt, Artificial Sequence
  CIITA targeting sequence
cucuguuuguauaugcaugc

SEQ ID NO: 43313 - RNA, 20 nt, Artificial Sequence
  CIITA targeting sequence
ucccucuguuuguauaugca

SEQ ID NO: 43314 - RNA, 20 nt, Artificial Sequence
  CIITA targeting sequence
uguacacgugcaugcucuuc

SEQ ID NO: 43315 - RNA, 20 nt, Artificial Sequence
  CIITA targeting sequence
ccaguugcaccaguuagcac

SEQ ID NO: 43316 - RNA, 20 nt, Artificial Sequence
  CIITA targeting sequence
ugcaacuuuucuguaagugu

SEQ ID NO: 43317 - RNA, 20 nt, Artificial Sequence
  CIITA targeting sequence
guaagugugaaauuacuuca

SEQ ID NO: 43318 - RNA, 20 nt, Artificial Sequence
  CIITA targeting sequence
cacuuacagaaaaguugcaa

SEQ ID NO: 43319 - RNA, 20 nt, Artificial Sequence
  CIITA targeting sequence
uaacagagguuuuuguuugu

SEQ ID NO: 43320 - RNA, 20 nt, Artificial Sequence
  CIITA targeting sequence
guuaugaaguaauuucacac

SEQ ID NO: 43321 - RNA, 20 nt, Artificial Sequence
  CIITA targeting sequence
ggaaaaaguuggaagagugc

SEQ ID NO: 43322 - RNA, 20 nt, Artificial Sequence
  CIITA targeting sequence
ugaauuaaaaacaaacaaac

SEQ ID NO: 43323 - RNA, 20 nt, Artificial Sequence
  CIITA targeting sequence
aacuuuuuccugaauuaaaa

SEQ ID NO: 43324 - RNA, 20 nt, Artificial Sequence
  CIITA targeting sequence
uccaacuuuuuccugaauua

SEQ ID NO: 43325 - RNA, 20 nt, Artificial Sequence
  CIITA targeting sequence
uacgcacucuuccaacuuuu

SEQ ID NO: 43326 - RNA, 20 nt, Artificial Sequence
  CIITA targeting sequence
gccaggccuauuucauacgc

SEQ ID NO: 43327 - RNA, 20 nt, Artificial Sequence
  CIITA targeting sequence
uaguuucugccaggccuauu

SEQ ID NO: 43328 - RNA, 20 nt, Artificial Sequence
  CIITA targeting sequence
aaggucggggauggggagcc

SEQ ID NO: 43329 - RNA, 20 nt, Artificial Sequence
  CIITA targeting sequence
gggauggggagcccucacug

SEQ ID NO: 43330 - RNA, 20 nt, Artificial Sequence
  CIITA targeting sequence
ccgaccuuggaacaccagcu

SEQ ID NO: 43331 - RNA, 20 nt, Artificial Sequence
  CIITA targeting sequence
ccauccccgaccuuggaaca

SEQ ID NO: 43332 - RNA, 20 nt, Artificial Sequence
  CIITA targeting sequence
cuggaggcaccccucaaacc

SEQ ID NO: 43333 - RNA, 20 nt, Artificial Sequence
  CIITA targeting sequence
agugagggcuccccaucccc

SEQ ID NO: 43334 - RNA, 20 nt, Artificial Sequence
  CIITA targeting sequence
aacccucagugcuguggcca

SEQ ID NO: 43335 - RNA, 20 nt, Artificial Sequence
  CIITA targeting sequence
gugcuguggccagggaaccg

SEQ ID NO: 43336 - RNA, 20 nt, Artificial Sequence
  CIITA targeting sequence
cuggccacagcacugagggu

SEQ ID NO: 43337 - RNA, 20 nt, Artificial Sequence
  CIITA targeting sequence
uaguuggcuuuguucccucg

SEQ ID NO: 43338 - RNA, 20 nt, Artificial Sequence
  CIITA targeting sequence
cucggccuccacuuccccau

SEQ ID NO: 43339 - RNA, 20 nt, Artificial Sequence
  CIITA targeting sequence
gccuccacuuccccauucug

SEQ ID NO: 43340 - RNA, 20 nt, Artificial Sequence
  CIITA targeting sequence
acuuccccauucugugccuc

SEQ ID NO: 43341 - RNA, 20 nt, Artificial Sequence
  CIITA targeting sequence
ccauucugugccuccauuua

SEQ ID NO: 43342 - RNA, 20 nt, Artificial Sequence
  CIITA targeting sequence
gugccuccauuuauuuguga

SEQ ID NO: 43343 - RNA, 20 nt, Artificial Sequence
  CIITA targeting sequence
auuuauuugugagacaggga

SEQ ID NO: 43344 - RNA, 20 nt, Artificial Sequence
  CIITA targeting sequence
caaauaaauggaggcacaga

SEQ ID NO: 43345 - RNA, 20 nt, Artificial Sequence
  CIITA targeting sequence
cacaaauaaauggaggcaca

SEQ ID NO: 43346 - RNA, 20 nt, Artificial Sequence
  CIITA targeting sequence
cugucucacaaauaaaugga

SEQ ID NO: 43347 - RNA, 20 nt, Artificial Sequence
  CIITA targeting sequence
uuaucccugucucacaaaua

SEQ ID NO: 43348 - RNA, 20 nt, Artificial Sequence
  CIITA targeting sequence
gccacuuuuauugugaucuu

SEQ ID NO: 43349 - RNA, 20 nt, Artificial Sequence
  CIITA targeting sequence
caauaaaaguggcagaccuc

SEQ ID NO: 43350 - RNA, 20 nt, Artificial Sequence
  CIITA targeting sequence
uagguuucccaaaagccgag

SEQ ID NO: 43351 - RNA, 20 nt, Artificial Sequence
  CIITA targeting sequence
caaaagccgaguaugcuuuc

SEQ ID NO: 43352 - RNA, 20 nt, Artificial Sequence
  CIITA targeting sequence
gcuuuugggaaaccuaagau

SEQ ID NO: 43353 - RNA, 20 nt, Artificial Sequence
  CIITA targeting sequence
gaaguucugggaggaaagcu

SEQ ID NO: 43354 - RNA, 20 nt, Artificial Sequence
  CIITA targeting sequence
gaaagcauacucggcuuuug

SEQ ID NO: 43355 - RNA, 20 nt, Artificial Sequence
  CIITA targeting sequence
gggaggaaagcuagcagaua

SEQ ID NO: 43356 - RNA, 20 nt, Artificial Sequence
  CIITA targeting sequence
cagaacuucugaaagcauac

SEQ ID NO: 43357 - RNA, 20 nt, Artificial Sequence
  CIITA targeting sequence
ucccagaacuucugaaagca

SEQ ID NO: 43358 - RNA, 20 nt, Artificial Sequence
  CIITA targeting sequence
gcuagcuuuccucccagaac

SEQ ID NO: 43359 - RNA, 20 nt, Artificial Sequence
  CIITA targeting sequence
gguuuaucugcuagcuuucc

SEQ ID NO: 43360 - RNA, 20 nt, Artificial Sequence
  CIITA targeting sequence
uauuucugguuuaucugcua

SEQ ID NO: 43361 - RNA, 20 nt, Artificial Sequence
  CIITA targeting sequence
aaauugagagaagcccucac

SEQ ID NO: 43362 - RNA, 20 nt, Artificial Sequence
  CIITA targeting sequence
auuuggauauucauauuucu

SEQ ID NO: 43363 - RNA, 20 nt, Artificial Sequence
  CIITA targeting sequence
caauuuggauauucauauuu

SEQ ID NO: 43364 - RNA, 20 nt, Artificial Sequence
  CIITA targeting sequence
cucaauuuggauauucauau

SEQ ID NO: 43365 - RNA, 20 nt, Artificial Sequence
  CIITA targeting sequence
cuuucuuaguucggcaaaac

SEQ ID NO: 43366 - RNA, 20 nt, Artificial Sequence
  CIITA targeting sequence
uaguucggcaaaacagacac

SEQ ID NO: 43367 - RNA, 20 nt, Artificial Sequence
  CIITA targeting sequence
gcaaaacagacacaugagcu

SEQ ID NO: 43368 - RNA, 20 nt, Artificial Sequence
  CIITA targeting sequence
guuuugccgaacuaagaaag

SEQ ID NO: 43369 - RNA, 20 nt, Artificial Sequence
  CIITA targeting sequence
ugugucuguuuugccgaacu

SEQ ID NO: 43370 - RNA, 20 nt, Artificial Sequence
  CIITA targeting sequence
gccccacuuacagcucaugu

SEQ ID NO: 43371 - RNA, 20 nt, Artificial Sequence
  CIITA targeting sequence
uggcugaaaucuccaguuug

SEQ ID NO: 43372 - RNA, 20 nt, Artificial Sequence
  CIITA targeting sequence
gccaagaaacaggcaggguc

SEQ ID NO: 43373 - RNA, 20 nt, Artificial Sequence
  CIITA targeting sequence
ccaguuuguauaauucaggg

SEQ ID NO: 43374 - RNA, 20 nt, Artificial Sequence
  CIITA targeting sequence
aguuuguauaauucagggcu

SEQ ID NO: 43375 - RNA, 20 nt, Artificial Sequence
  CIITA targeting sequence
gggcuaagagagcaggacuc

SEQ ID NO: 43376 - RNA, 20 nt, Artificial Sequence
  CIITA targeting sequence
uagcccugaauuauacaaac

SEQ ID NO: 43377 - RNA, 20 nt, Artificial Sequence
  CIITA targeting sequence
cuuagcccugaauuauacaa

SEQ ID NO: 43378 - RNA, 20 nt, Artificial Sequence
  CIITA targeting sequence
ugcucucuuagcccugaauu

SEQ ID NO: 43379 - RNA, 20 nt, Artificial Sequence
  CIITA targeting sequence
ugacaucucacugucuugag

SEQ ID NO: 43380 - RNA, 20 nt, Artificial Sequence
  CIITA targeting sequence
agaguccugcucucuuagcc

SEQ ID NO: 43381 - RNA, 20 nt, Artificial Sequence
  CIITA targeting sequence
cacugucuugagacacauac

SEQ ID NO: 43382 - RNA, 20 nt, Artificial Sequence
  CIITA targeting sequence
cugucuugagacacauacug

SEQ ID NO: 43383 - RNA, 20 nt, Artificial Sequence
  CIITA targeting sequence
ugagacacauacugggguuu

SEQ ID NO: 43384 - RNA, 20 nt, Artificial Sequence
  CIITA targeting sequence
agacagugagaugucaagag

SEQ ID NO: 43385 - RNA, 20 nt, Artificial Sequence
  CIITA targeting sequence
caagacagugagaugucaag

SEQ ID NO: 43386 - RNA, 20 nt, Artificial Sequence
  CIITA targeting sequence
ccugucugaagacgcagcug

SEQ ID NO: 43387 - RNA, 20 nt, Artificial Sequence
  CIITA targeting sequence
ugucugaagacgcagcuggc

SEQ ID NO: 43388 - RNA, 20 nt, Artificial Sequence
  CIITA targeting sequence
gaagacgcagcuggcaccaa

SEQ ID NO: 43389 - RNA, 20 nt, Artificial Sequence
  CIITA targeting sequence
gacaggagaaaaccccagua

SEQ ID NO: 43390 - RNA, 20 nt, Artificial Sequence
  CIITA targeting sequence
ucagacaggagaaaacccca

SEQ ID NO: 43391 - RNA, 20 nt, Artificial Sequence
  CIITA targeting sequence
uuggccauaggguacauugg

SEQ ID NO: 43392 - RNA, 20 nt, Artificial Sequence
  CIITA targeting sequence
gggugagccucaugucagga

SEQ ID NO: 43393 - RNA, 20 nt, Artificial Sequence
  CIITA targeting sequence
cccagaagguccuuggccau

SEQ ID NO: 43394 - RNA, 20 nt, Artificial Sequence
  CIITA targeting sequence
ugucaggagcagagcuggag

SEQ ID NO: 43395 - RNA, 20 nt, Artificial Sequence
  CIITA targeting sequence
ggagcagagcuggagaggug

SEQ ID NO: 43396 - RNA, 20 nt, Artificial Sequence
  CIITA targeting sequence
ugacaugaggcucacccaga

SEQ ID NO: 43397 - RNA, 20 nt, Artificial Sequence
  CIITA targeting sequence
gcuccugacaugaggcucac

SEQ ID NO: 43398 - RNA, 20 nt, Artificial Sequence
  CIITA targeting sequence
agcucugcuccugacaugag

SEQ ID NO: 43399 - RNA, 20 nt, Artificial Sequence
  CIITA targeting sequence
ccagcucugcuccugacaug

SEQ ID NO: 43400 - RNA, 20 nt, Artificial Sequence
  CIITA targeting sequence
cugugucaccauugucuguc

SEQ ID NO: 43401 - RNA, 20 nt, Artificial Sequence
  CIITA targeting sequence
ccauugucugucucuugcuu

SEQ ID NO: 43402 - RNA, 20 nt, Artificial Sequence
  CIITA targeting sequence
gucucuugcuuagaugacag

SEQ ID NO: 43403 - RNA, 20 nt, Artificial Sequence
  CIITA targeting sequence
cuugcuuagaugacagccac

SEQ ID NO: 43404 - RNA, 20 nt, Artificial Sequence
  CIITA targeting sequence
ugcuuagaugacagccacag

SEQ ID NO: 43405 - RNA, 20 nt, Artificial Sequence
  CIITA targeting sequence
aagcaagagacagacaaugg

SEQ ID NO: 43406 - RNA, 20 nt, Artificial Sequence
  CIITA targeting sequence
ucuaagcaagagacagacaa

SEQ ID NO: 43407 - RNA, 20 nt, Artificial Sequence
  CIITA targeting sequence
uggccugguuuccugcaucc

SEQ ID NO: 43408 - RNA, 20 nt, Artificial Sequence
  CIITA targeting sequence
ugcauccgcccugaccccug

SEQ ID NO: 43409 - RNA, 20 nt, Artificial Sequence
  CIITA targeting sequence
gcccugaccccuggcugugg

SEQ ID NO: 43410 - RNA, 20 nt, Artificial Sequence
  CIITA targeting sequence
gggcggaugcaggaaaccag

SEQ ID NO: 43411 - RNA, 20 nt, Artificial Sequence
  CIITA targeting sequence
cacagccaggggucagggcg

SEQ ID NO: 43412 - RNA, 20 nt, Artificial Sequence
  CIITA targeting sequence
cccauaacucaaaucugacu

SEQ ID NO: 43413 - RNA, 20 nt, Artificial Sequence
  CIITA targeting sequence
cauaacucaaaucugacugu

SEQ ID NO: 43414 - RNA, 20 nt, Artificial Sequence
  CIITA targeting sequence
aaucugacugugucccugug

SEQ ID NO: 43415 - RNA, 20 nt, Artificial Sequence
  CIITA targeting sequence
gacugugucccuguggaagg

SEQ ID NO: 43416 - RNA, 20 nt, Artificial Sequence
  CIITA targeting sequence
gauuugaguuaugggagauc

SEQ ID NO: 43417 - RNA, 20 nt, Artificial Sequence
  CIITA targeting sequence
cuguggaagguuuggguuuc

SEQ ID NO: 43418 - RNA, 20 nt, Artificial Sequence
  CIITA targeting sequence
acagggacacagucagauuu

SEQ ID NO: 43419 - RNA, 20 nt, Artificial Sequence
  CIITA targeting sequence
gaccugggcagcucuauguc

SEQ ID NO: 43420 - RNA, 20 nt, Artificial Sequence
  CIITA targeting sequence
gaaacccaaaccuuccacag

SEQ ID NO: 43421 - RNA, 20 nt, Artificial Sequence
  CIITA targeting sequence
auguccggcacagggguucu

SEQ ID NO: 43422 - RNA, 20 nt, Artificial Sequence
  CIITA targeting sequence
ggcacagggguucugcugau

SEQ ID NO: 43423 - RNA, 20 nt, Artificial Sequence
  CIITA targeting sequence
gcugauagcacaggccacag

SEQ ID NO: 43424 - RNA, 20 nt, Artificial Sequence
  CIITA targeting sequence
gcagaaccccugugccggac

SEQ ID NO: 43425 - RNA, 20 nt, Artificial Sequence
  CIITA targeting sequence
guggccugugcuaucagcag

SEQ ID NO: 43426 - RNA, 20 nt, Artificial Sequence
  CIITA targeting sequence
uugccaaucuguggccugug

SEQ ID NO: 43427 - RNA, 20 nt, Artificial Sequence
  CIITA targeting sequence
cuccuugccaaucuguggcc

SEQ ID NO: 43428 - RNA, 20 nt, Artificial Sequence
  CIITA targeting sequence
uaaccuggucccuccuugcc

SEQ ID NO: 43429 - RNA, 20 nt, Artificial Sequence
  CIITA targeting sequence
uuccuaaccuggucccuccu

SEQ ID NO: 43430 - RNA, 20 nt, Artificial Sequence
  CIITA targeting sequence
uaguugggagauaacugaag

SEQ ID NO: 43431 - RNA, 20 nt, Artificial Sequence
  CIITA targeting sequence
caacuaggaaccacagcugc

SEQ ID NO: 43432 - RNA, 20 nt, Artificial Sequence
  CIITA targeting sequence
cccaacuaggaaccacagcu

SEQ ID NO: 43433 - RNA, 20 nt, Artificial Sequence
  CIITA targeting sequence
guuaucucccaacuaggaac

SEQ ID NO: 43434 - RNA, 20 nt, Artificial Sequence
  CIITA targeting sequence
uaggcuucaguuaucuccca

SEQ ID NO: 43435 - RNA, 20 nt, Artificial Sequence
  CIITA targeting sequence
uggaauaagauagaccaaug

SEQ ID NO: 43436 - RNA, 20 nt, Artificial Sequence
  CIITA targeting sequence
aggauuuccuaggcuucagu

SEQ ID NO: 43437 - RNA, 20 nt, Artificial Sequence
  CIITA targeting sequence
uauuccaggauuuccuaggc

SEQ ID NO: 43438 - RNA, 20 nt, Artificial Sequence
  CIITA targeting sequence
aucuuauuccaggauuuccu

SEQ ID NO: 43439 - RNA, 20 nt, Artificial Sequence
  CIITA targeting sequence
auaacccucagcuccaaauc

SEQ ID NO: 43440 - RNA, 20 nt, Artificial Sequence
  CIITA targeting sequence
augcauuggucuaucuuauu

SEQ ID NO: 43441 - RNA, 20 nt, Artificial Sequence
  CIITA targeting sequence
gcuccaaaucugagcugcac

SEQ ID NO: 43442 - RNA, 20 nt, Artificial Sequence
  CIITA targeting sequence
aaaucugagcugcaccagga

SEQ ID NO: 43443 - RNA, 20 nt, Artificial Sequence
  CIITA targeting sequence
gagcugcaccaggacaagcu

SEQ ID NO: 43444 - RNA, 20 nt, Artificial Sequence
  CIITA targeting sequence
gauuuggagcugaggguuau

SEQ ID NO: 43445 - RNA, 20 nt, Artificial Sequence
  CIITA targeting sequence
uggugcagcucagauuugga

SEQ ID NO: 43446 - RNA, 20 nt, Artificial Sequence
  CIITA targeting sequence
gcuuguccuggugcagcuca

SEQ ID NO: 43447 - RNA, 20 nt, Artificial Sequence
  CIITA targeting sequence
gguggcaacguucuccaguc

SEQ ID NO: 43448 - RNA, 20 nt, Artificial Sequence
  CIITA targeting sequence
ccagucucugcauuuucagc

SEQ ID NO: 43449 - RNA, 20 nt, Artificial Sequence
  CIITA targeting sequence
agucucugcauuuucagcuc

SEQ ID NO: 43450 - RNA, 20 nt, Artificial Sequence
  CIITA targeting sequence
cugcauuuucagcucgcugu

SEQ ID NO: 43451 - RNA, 20 nt, Artificial Sequence
  CIITA targeting sequence
gcauuuucagcucgcugugu

SEQ ID NO: 43452 - RNA, 20 nt, Artificial Sequence
  CIITA targeting sequence
gcucgcugugugccaagaga

SEQ ID NO: 43453 - RNA, 20 nt, Artificial Sequence
  CIITA targeting sequence
cugugugccaagagagggcu

SEQ ID NO: 43454 - RNA, 20 nt, Artificial Sequence
  CIITA targeting sequence
uggcacacagcgagcugaaa

SEQ ID NO: 43455 - RNA, 20 nt, Artificial Sequence
  CIITA targeting sequence
cuuggcacacagcgagcuga

SEQ ID NO: 43456 - RNA, 20 nt, Artificial Sequence
  CIITA targeting sequence
cuuucauuaggaaccgggac

SEQ ID NO: 43457 - RNA, 20 nt, Artificial Sequence
  CIITA targeting sequence
uuaggaaccgggacgaauaa

SEQ ID NO: 43458 - RNA, 20 nt, Artificial Sequence
  CIITA targeting sequence
uaaugaaagugaaagcugcu

SEQ ID NO: 43459 - RNA, 20 nt, Artificial Sequence
  CIITA targeting sequence
cgguuccuaaugaaagugaa

SEQ ID NO: 43460 - RNA, 20 nt, Artificial Sequence
  CIITA targeting sequence
ucccgguuccuaaugaaagu

SEQ ID NO: 43461 - RNA, 20 nt, Artificial Sequence
  CIITA targeting sequence
aacugagcugccucugcacc

SEQ ID NO: 43462 - RNA, 20 nt, Artificial Sequence
  CIITA targeting sequence
guuggauuauucgucccggu

SEQ ID NO: 43463 - RNA, 20 nt, Artificial Sequence
  CIITA targeting sequence
gcaccagaacugcugggacg

SEQ ID NO: 43464 - RNA, 20 nt, Artificial Sequence
  CIITA targeting sequence
ggugcagaggcagcucaguu

SEQ ID NO: 43465 - RNA, 20 nt, Artificial Sequence
  CIITA targeting sequence
cagcaguucuggugcagagg

SEQ ID NO: 43466 - RNA, 20 nt, Artificial Sequence
  CIITA targeting sequence
cgucccagcaguucuggugc

SEQ ID NO: 43467 - RNA, 20 nt, Artificial Sequence
  CIITA targeting sequence
ucacgucccagcaguucugg

SEQ ID NO: 43468 - RNA, 20 nt, Artificial Sequence
  CIITA targeting sequence
cccuggcucccaggccagcc

SEQ ID NO: 43469 - RNA, 20 nt, Artificial Sequence
  CIITA targeting sequence
cuggcucccaggccagccac

SEQ ID NO: 43470 - RNA, 20 nt, Artificial Sequence
  CIITA targeting sequence
caggccagccacugcagccc

SEQ ID NO: 43471 - RNA, 20 nt, Artificial Sequence
  CIITA targeting sequence
ccugggaaggagggagcucc

SEQ ID NO: 43472 - RNA, 20 nt, Artificial Sequence
  CIITA targeting sequence
ugggaaggagggagcucccg

SEQ ID NO: 43473 - RNA, 20 nt, Artificial Sequence
  CIITA targeting sequence
caggagaaagggcugcagug

SEQ ID NO: 43474 - RNA, 20 nt, Artificial Sequence
  CIITA targeting sequence
uucccaggagaaagggcugc

SEQ ID NO: 43475 - RNA, 20 nt, Artificial Sequence
  CIITA targeting sequence
cuccuucccaggagaaaggg

SEQ ID NO: 43476 - RNA, 20 nt, Artificial Sequence
  CIITA targeting sequence
cgauuccccauucccugcuc

SEQ ID NO: 43477 - RNA, 20 nt, Artificial Sequence
  CIITA targeting sequence
ggagcucccuccuucccagg

SEQ ID NO: 43478 - RNA, 20 nt, Artificial Sequence
  CIITA targeting sequence
ccauucccugcuccugggca

SEQ ID NO: 43479 - RNA, 20 nt, Artificial Sequence
  CIITA targeting sequence
cugcuccugggcaacaauua

SEQ ID NO: 43480 - RNA, 20 nt, Artificial Sequence
  CIITA targeting sequence
ugggcaacaauuaacacucu

SEQ ID NO: 43481 - RNA, 20 nt, Artificial Sequence
  CIITA targeting sequence
aggaaaaccacagagccggc

SEQ ID NO: 43482 - RNA, 20 nt, Artificial Sequence
  CIITA targeting sequence
uagaguguuaauuguugccc

SEQ ID NO: 43483 - RNA, 20 nt, Artificial Sequence
  CIITA targeting sequence
gugguuuuccuagaguguua

SEQ ID NO: 43484 - RNA, 20 nt, Artificial Sequence
  CIITA targeting sequence
aggguucuggugcccugggg

SEQ ID NO: 43485 - RNA, 20 nt, Artificial Sequence
  CIITA targeting sequence
ggugcccuggggaccacagg

SEQ ID NO: 43486 - RNA, 20 nt, Artificial Sequence
  CIITA targeting sequence
ccagggcaccagaacccugg

SEQ ID NO: 43487 - RNA, 20 nt, Artificial Sequence
  CIITA targeting sequence
ugcugcccugugguccccag

SEQ ID NO: 43488 - RNA, 20 nt, Artificial Sequence
  CIITA targeting sequence
ccuaaggguccuggggcugg

SEQ ID NO: 43489 - RNA, 20 nt, Artificial Sequence
  CIITA targeting sequence
uaaggguccuggggcuggga

SEQ ID NO: 43490 - RNA, 20 nt, Artificial Sequence
  CIITA targeting sequence
uggggcugggaaggcagagu

SEQ ID NO: 43491 - RNA, 20 nt, Artificial Sequence
  CIITA targeting sequence
cagccccaggacccuuagga

SEQ ID NO: 43492 - RNA, 20 nt, Artificial Sequence
  CIITA targeting sequence
gccuucccagccccaggacc

SEQ ID NO: 43493 - RNA, 20 nt, Artificial Sequence
  CIITA targeting sequence
cacucugccuucccagcccc

SEQ ID NO: 43494 - RNA, 20 nt, Artificial Sequence
  CIITA targeting sequence
cccccagcuaggcuagaccu

SEQ ID NO: 43495 - RNA, 20 nt, Artificial Sequence
  CIITA targeting sequence
cccagcuaggcuagaccugg

SEQ ID NO: 43496 - RNA, 20 nt, Artificial Sequence
  CIITA targeting sequence
agccuagcugggggagacuu

SEQ ID NO: 43497 - RNA, 20 nt, Artificial Sequence
  CIITA targeting sequence
aggucuagccuagcuggggg

SEQ ID NO: 43498 - RNA, 20 nt, Artificial Sequence
  CIITA targeting sequence
cuggcacucaggcagccugu

SEQ ID NO: 43499 - RNA, 20 nt, Artificial Sequence
  CIITA targeting sequence
ggcagccuguccucuucugc

SEQ ID NO: 43500 - RNA, 20 nt, Artificial Sequence
  CIITA targeting sequence
ucuucugcucacaggauaua

SEQ ID NO: 43501 - RNA, 20 nt, Artificial Sequence
  CIITA targeting sequence
ucugcucacaggauauaaau

SEQ ID NO: 43502 - RNA, 20 nt, Artificial Sequence
  CIITA targeting sequence
gcucacaggauauaaauauu

SEQ ID NO: 43503 - RNA, 20 nt, Artificial Sequence
  CIITA targeting sequence
caggauauaaauauucaugc

SEQ ID NO: 43504 - RNA, 20 nt, Artificial Sequence
  CIITA targeting sequence
ugugagcagaagaggacagg

SEQ ID NO: 43505 - RNA, 20 nt, Artificial Sequence
  CIITA targeting sequence
ugcaugaguauaggugcagg

SEQ ID NO: 43506 - RNA, 20 nt, Artificial Sequence
  CIITA targeting sequence
ugcaugaauauuuauauccu

SEQ ID NO: 43507 - RNA, 20 nt, Artificial Sequence
  CIITA targeting sequence
auuguauccgacuaugaaua

SEQ ID NO: 43508 - RNA, 20 nt, Artificial Sequence
  CIITA targeting sequence
gacuaugaauaugagugguu

SEQ ID NO: 43509 - RNA, 20 nt, Artificial Sequence
  CIITA targeting sequence
gauacaauggaaagcguguu

SEQ ID NO: 43510 - RNA, 20 nt, Artificial Sequence
  CIITA targeting sequence
uagucggauacaauggaaag

SEQ ID NO: 43511 - RNA, 20 nt, Artificial Sequence
  CIITA targeting sequence
uauucauagucggauacaau

SEQ ID NO: 43512 - RNA, 20 nt, Artificial Sequence
  CIITA targeting sequence
cuuacuauauacaaggagau

SEQ ID NO: 43513 - RNA, 20 nt, Artificial Sequence
  CIITA targeting sequence
uacuauauacaaggagaucu

SEQ ID NO: 43514 - RNA, 20 nt, Artificial Sequence
  CIITA targeting sequence
uuguauauaguaagagaugu

SEQ ID NO: 43515 - RNA, 20 nt, Artificial Sequence
  CIITA targeting sequence
ccuuguauauaguaagagau

SEQ ID NO: 43516 - RNA, 20 nt, Artificial Sequence
  CIITA targeting sequence
aagugcuuuauguauaucuc

SEQ ID NO: 43517 - RNA, 20 nt, Artificial Sequence
  CIITA targeting sequence
caccuaauccucacaacaag

SEQ ID NO: 43518 - RNA, 20 nt, Artificial Sequence
  CIITA targeting sequence
ccuaauccucacaacaaggg

SEQ ID NO: 43519 - RNA, 20 nt, Artificial Sequence
  CIITA targeting sequence
ucacaacaagggagauuuuc

SEQ ID NO: 43520 - RNA, 20 nt, Artificial Sequence
  CIITA targeting sequence
caacaagggagauuuucauu

SEQ ID NO: 43521 - RNA, 20 nt, Artificial Sequence
  CIITA targeting sequence
cuuguugugaggauuaggug

SEQ ID NO: 43522 - RNA, 20 nt, Artificial Sequence
  CIITA targeting sequence
cccuuguugugaggauuagg

SEQ ID NO: 43523 - RNA, 20 nt, Artificial Sequence
  CIITA targeting sequence
uuauuuccaucuucuagaag

SEQ ID NO: 43524 - RNA, 20 nt, Artificial Sequence
  CIITA targeting sequence
aucuucuagaagaggaaacc

SEQ ID NO: 43525 - RNA, 20 nt, Artificial Sequence
  CIITA targeting sequence
ucuagaagaggaaaccaaag

SEQ ID NO: 43526 - RNA, 20 nt, Artificial Sequence
  CIITA targeting sequence
agaagaggaaaccaaaguac

SEQ ID NO: 43527 - RNA, 20 nt, Artificial Sequence
  CIITA targeting sequence
agaagauggaaauaaugaaa

SEQ ID NO: 43528 - RNA, 20 nt, Artificial Sequence
  CIITA targeting sequence
ucuagaagauggaaauaaug

SEQ ID NO: 43529 - RNA, 20 nt, Artificial Sequence
  CIITA targeting sequence
ucuucuagaagauggaaaua

SEQ ID NO: 43530 - RNA, 20 nt, Artificial Sequence
  CIITA targeting sequence
cuguacuuugguuuccucuu

SEQ ID NO: 43531 - RNA, 20 nt, Artificial Sequence
  CIITA targeting sequence
cagcuacccugggaugugaa

SEQ ID NO: 43532 - RNA, 20 nt, Artificial Sequence
  CIITA targeting sequence
caggguagcugugaccuugg

SEQ ID NO: 43533 - RNA, 20 nt, Artificial Sequence
  CIITA targeting sequence
caucccaggguagcugugac

SEQ ID NO: 43534 - RNA, 20 nt, Artificial Sequence
  CIITA targeting sequence
uaaccaugacccuaauacug

SEQ ID NO: 43535 - RNA, 20 nt, Artificial Sequence
  CIITA targeting sequence
ugguuaagagccagggcccu

SEQ ID NO: 43536 - RNA, 20 nt, Artificial Sequence
  CIITA targeting sequence
ucaaguaggugcucagcaaa

SEQ ID NO: 43537 - RNA, 20 nt, Artificial Sequence
  CIITA targeting sequence
aguaggugcucagcaaaugu

SEQ ID NO: 43538 - RNA, 20 nt, Artificial Sequence
  CIITA targeting sequence
gcaaauguuugaggaacuga

SEQ ID NO: 43539 - RNA, 20 nt, Artificial Sequence
  CIITA targeting sequence
aacauuugcugagcaccuac

SEQ ID NO: 43540 - RNA, 20 nt, Artificial Sequence
  CIITA targeting sequence
ucaaacauuugcugagcacc

SEQ ID NO: 43541 - RNA, 20 nt, Artificial Sequence
  CIITA targeting sequence
guuccucaaacauuugcuga

SEQ ID NO: 43542 - RNA, 20 nt, Artificial Sequence
  CIITA targeting sequence
acacauaagagaaaaaaaaa

SEQ ID NO: 43543 - RNA, 20 nt, Artificial Sequence
  CIITA targeting sequence
uauguguggacccacauaau

SEQ ID NO: 43544 - RNA, 20 nt, Artificial Sequence
  CIITA targeting sequence
cuuauguguggacccacaua

SEQ ID NO: 43545 - RNA, 20 nt, Artificial Sequence
  CIITA targeting sequence
uuuuuuuuuuuuucucuuau

SEQ ID NO: 43546 - RNA, 20 nt, Artificial Sequence
  CIITA targeting sequence
cucuuuuuuuuuuuuuucuc

SEQ ID NO: 43547 - RNA, 20 nt, Artificial Sequence
  CIITA targeting sequence
ucuugagauucauccugggc

SEQ ID NO: 43548 - RNA, 20 nt, Artificial Sequence
  CIITA targeting sequence
ugagauucauccugggcccc

SEQ ID NO: 43549 - RNA, 20 nt, Artificial Sequence
  CIITA targeting sequence
agaugaacaggugcaccuac

SEQ ID NO: 43550 - RNA, 20 nt, Artificial Sequence
  CIITA targeting sequence
caagaugaacaggugcaccu

SEQ ID NO: 43551 - RNA, 20 nt, Artificial Sequence
  CIITA targeting sequence
uccugggccccacuguguga

SEQ ID NO: 43552 - RNA, 20 nt, Artificial Sequence
  CIITA targeting sequence
ugggccccacugugugacau

SEQ ID NO: 43553 - RNA, 20 nt, Artificial Sequence
  CIITA targeting sequence
cacaguggggcccaggauga

SEQ ID NO: 43554 - RNA, 20 nt, Artificial Sequence
  CIITA targeting sequence
acgcccuuagucacuguuuc

SEQ ID NO: 43555 - RNA, 20 nt, Artificial Sequence
  CIITA targeting sequence
cuguuuccuggauuggcgug

SEQ ID NO: 43556 - RNA, 20 nt, Artificial Sequence
  CIITA targeting sequence
uggauuggcguguggggaac

SEQ ID NO: 43557 - RNA, 20 nt, Artificial Sequence
  CIITA targeting sequence
aggaaacagugacuaagggc

SEQ ID NO: 43558 - RNA, 20 nt, Artificial Sequence
  CIITA targeting sequence
ccacacgccaauccaggaaa

SEQ ID NO: 43559 - RNA, 20 nt, Artificial Sequence
  CIITA targeting sequence
cauguguuccccacacgcca

SEQ ID NO: 43560 - RNA, 20 nt, Artificial Sequence
  CIITA targeting sequence
uguggucacauguguucccc

SEQ ID NO: 43561 - RNA, 20 nt, Artificial Sequence
  CIITA targeting sequence
cauguggucacauguguucc

SEQ ID NO: 43562 - RNA, 20 nt, Artificial Sequence
  CIITA targeting sequence
gccauucucauguggucaca

SEQ ID NO: 43563 - RNA, 20 nt, Artificial Sequence
  CIITA targeting sequence
cagccauucucaugugguca

SEQ ID NO: 43564 - RNA, 20 nt, Artificial Sequence
  CIITA targeting sequence
uucucagccauucucaugug

SEQ ID NO: 43565 - RNA, 20 nt, Artificial Sequence
  CIITA targeting sequence
ugcucuuucucagccauucu

SEQ ID NO: 43566 - RNA, 20 nt, Artificial Sequence
  CIITA targeting sequence
guccugcucuuucucagcca

SEQ ID NO: 43567 - RNA, 20 nt, Artificial Sequence
  CIITA targeting sequence
ccugcuuauggaaaggggcc

SEQ ID NO: 43568 - RNA, 20 nt, Artificial Sequence
  CIITA targeting sequence
auaagcaggggaacgccggu

SEQ ID NO: 43569 - RNA, 20 nt, Artificial Sequence
  CIITA targeting sequence
aggccccuuuccauaagcag

SEQ ID NO: 43570 - RNA, 20 nt, Artificial Sequence
  CIITA targeting sequence
ccaggccccuuuccauaagc

SEQ ID NO: 43571 - RNA, 20 nt, Artificial Sequence
  CIITA targeting sequence
ucuccaggccccuuuccaua

SEQ ID NO: 43572 - RNA, 20 nt, Artificial Sequence
  CIITA targeting sequence
gucagaucaucuugaggucu

SEQ ID NO: 43573 - RNA, 20 nt, Artificial Sequence
  CIITA targeting sequence
gaucaucuugaggucuuucc

SEQ ID NO: 43574 - RNA, 20 nt, Artificial Sequence
  CIITA targeting sequence
gaccgagccucaucuccagg

SEQ ID NO: 43575 - RNA, 20 nt, Artificial Sequence
  CIITA targeting sequence
ucuugaggucuuuccuggcg

SEQ ID NO: 43576 - RNA, 20 nt, Artificial Sequence
  CIITA targeting sequence
ugaggucuuuccuggcggcu

SEQ ID NO: 43577 - RNA, 20 nt, Artificial Sequence
  CIITA targeting sequence
agaugaucugaccgagccuc

SEQ ID NO: 43578 - RNA, 20 nt, Artificial Sequence
  CIITA targeting sequence
uuccuggcggcuucccugcu

SEQ ID NO: 43579 - RNA, 20 nt, Artificial Sequence
  CIITA targeting sequence
uggcggcuucccugcugcua

SEQ ID NO: 43580 - RNA, 20 nt, Artificial Sequence
  CIITA targeting sequence
cugcugcuagcuaccccucu

SEQ ID NO: 43581 - RNA, 20 nt, Artificial Sequence
  CIITA targeting sequence
cauacccugggguucugagc

SEQ ID NO: 43582 - RNA, 20 nt, Artificial Sequence
  CIITA targeting sequence
uacccugggguucugagcuu

SEQ ID NO: 43583 - RNA, 20 nt, Artificial Sequence
  CIITA targeting sequence
gagcuuccucggcacuuggg

SEQ ID NO: 43584 - RNA, 20 nt, Artificial Sequence
  CIITA targeting sequence
gaaccccaggguaugagagg

SEQ ID NO: 43585 - RNA, 20 nt, Artificial Sequence
  CIITA targeting sequence
ucggcacuugggggcaaggc

SEQ ID NO: 43586 - RNA, 20 nt, Artificial Sequence
  CIITA targeting sequence
gcacuugggggcaaggccuc

SEQ ID NO: 43587 - RNA, 20 nt, Artificial Sequence
  CIITA targeting sequence
uuggcuuggauuugagggug

SEQ ID NO: 43588 - RNA, 20 nt, Artificial Sequence
  CIITA targeting sequence
aagccaaggaggccuugccc

SEQ ID NO: 43589 - RNA, 20 nt, Artificial Sequence
  CIITA targeting sequence
aauccaagccaaggaggccu

SEQ ID NO: 43590 - RNA, 20 nt, Artificial Sequence
  CIITA targeting sequence
ccacccucaaauccaagcca

SEQ ID NO: 43591 - RNA, 20 nt, Artificial Sequence
  CIITA targeting sequence
uccccacccucaaauccaag

SEQ ID NO: 43592 - RNA, 20 nt, Artificial Sequence
  CIITA targeting sequence
cuccuccccacccucaaauc

SEQ ID NO: 43593 - RNA, 20 nt, Artificial Sequence
  CIITA targeting sequence
accacuucuccaggccuccc

SEQ ID NO: 43594 - RNA, 20 nt, Artificial Sequence
  CIITA targeting sequence
ccaggccuccccacuuccca

SEQ ID NO: 43595 - RNA, 20 nt, Artificial Sequence
  CIITA targeting sequence
aggccuccccacuucccagg

SEQ ID NO: 43596 - RNA, 20 nt, Artificial Sequence
  CIITA targeting sequence
ccacuucccagggucaggcc

SEQ ID NO: 43597 - RNA, 20 nt, Artificial Sequence
  CIITA targeting sequence
cagggucaggcccugacacc

SEQ ID NO: 43598 - RNA, 20 nt, Artificial Sequence
  CIITA targeting sequence
ggcccugacaccccgagagc

SEQ ID NO: 43599 - RNA, 20 nt, Artificial Sequence
  CIITA targeting sequence
gggccugacccugggaagug

SEQ ID NO: 43600 - RNA, 20 nt, Artificial Sequence
  CIITA targeting sequence
gggugucagggccugacccu

SEQ ID NO: 43601 - RNA, 20 nt, Artificial Sequence
  CIITA targeting sequence
cggggugucagggccugacc

SEQ ID NO: 43602 - RNA, 20 nt, Artificial Sequence
  CIITA targeting sequence
cugagagauauuuccuggug

SEQ ID NO: 43603 - RNA, 20 nt, Artificial Sequence
  CIITA targeting sequence
gggacacccuugcaaagcuc

SEQ ID NO: 43604 - RNA, 20 nt, Artificial Sequence
  CIITA targeting sequence
cagggacacccuugcaaagc

SEQ ID NO: 43605 - RNA, 20 nt, Artificial Sequence
  CIITA targeting sequence
cucagggacacccuugcaaa

SEQ ID NO: 43606 - RNA, 20 nt, Artificial Sequence
  CIITA targeting sequence
ugguguuucugcuuaaacag

SEQ ID NO: 43607 - RNA, 20 nt, Artificial Sequence
  CIITA targeting sequence
gcuuaaacagcguuugcugc

SEQ ID NO: 43608 - RNA, 20 nt, Artificial Sequence
  CIITA targeting sequence
aagcauuugggauucaguuu

SEQ ID NO: 43609 - RNA, 20 nt, Artificial Sequence
  CIITA targeting sequence
acauauuuugcagcaaacgc

SEQ ID NO: 43610 - RNA, 20 nt, Artificial Sequence
  CIITA targeting sequence
caaaugcuucgacauauuuu

SEQ ID NO: 43611 - RNA, 20 nt, Artificial Sequence
  CIITA targeting sequence
guuuuuaguucagaauaugc

SEQ ID NO: 43612 - RNA, 20 nt, Artificial Sequence
  CIITA targeting sequence
gaauaugccaauguuuucau

SEQ ID NO: 43613 - RNA, 20 nt, Artificial Sequence
  CIITA targeting sequence
gaacuaaaaacugaauccca

SEQ ID NO: 43614 - RNA, 20 nt, Artificial Sequence
  CIITA targeting sequence
uuuggaaggggaaguguuuc

SEQ ID NO: 43615 - RNA, 20 nt, Artificial Sequence
  CIITA targeting sequence
aaaugaaaacauuggcauau

SEQ ID NO: 43616 - RNA, 20 nt, Artificial Sequence
  CIITA targeting sequence
ccuuccaaaugaaaacauug

SEQ ID NO: 43617 - RNA, 20 nt, Artificial Sequence
  CIITA targeting sequence
guugaugugguaaagagaua

SEQ ID NO: 43618 - RNA, 20 nt, Artificial Sequence
  CIITA targeting sequence
acagaaacacuuccccuucc

SEQ ID NO: 43619 - RNA, 20 nt, Artificial Sequence
  CIITA targeting sequence
uuaccacaucaacagaaaca

SEQ ID NO: 43620 - RNA, 20 nt, Artificial Sequence
  CIITA targeting sequence
cuuuaccacaucaacagaaa

SEQ ID NO: 43621 - RNA, 20 nt, Artificial Sequence
  CIITA targeting sequence
uauuuuaucucuuuaccaca

SEQ ID NO: 43622 - RNA, 20 nt, Artificial Sequence
  CIITA targeting sequence
ucaccaaguuacacugcuuc

SEQ ID NO: 43623 - RNA, 20 nt, Artificial Sequence
  CIITA targeting sequence
ccaaguuacacugcuucaaa

SEQ ID NO: 43624 - RNA, 20 nt, Artificial Sequence
  CIITA targeting sequence
aagucaaaugcuuggcuugg

SEQ ID NO: 43625 - RNA, 20 nt, Artificial Sequence
  CIITA targeting sequence
aaugcuuggcuuggagacag

SEQ ID NO: 43626 - RNA, 20 nt, Artificial Sequence
  CIITA targeting sequence
aagccaagcauuugacuuug

SEQ ID NO: 43627 - RNA, 20 nt, Artificial Sequence
  CIITA targeting sequence
ccaagccaagcauuugacuu

SEQ ID NO: 43628 - RNA, 20 nt, Artificial Sequence
  CIITA targeting sequence
cugucuccaagccaagcauu

SEQ ID NO: 43629 - RNA, 20 nt, Artificial Sequence
  CIITA targeting sequence
ugggaucgcaggcccuuagc

SEQ ID NO: 43630 - RNA, 20 nt, Artificial Sequence
  CIITA targeting sequence
caagauaaaucccugucucc

SEQ ID NO: 43631 - RNA, 20 nt, Artificial Sequence
  CIITA targeting sequence
caggcccuuagcacacggcc

SEQ ID NO: 43632 - RNA, 20 nt, Artificial Sequence
  CIITA targeting sequence
gccaggccgugugcuaaggg

SEQ ID NO: 43633 - RNA, 20 nt, Artificial Sequence
  CIITA targeting sequence
ucugccaggccgugugcuaa

SEQ ID NO: 43634 - RNA, 20 nt, Artificial Sequence
  CIITA targeting sequence
aagucuguugaaugagugag

SEQ ID NO: 43635 - RNA, 20 nt, Artificial Sequence
  CIITA targeting sequence
guugaaugagugagugcaua

SEQ ID NO: 43636 - RNA, 20 nt, Artificial Sequence
  CIITA targeting sequence
acagacuuugacccugccug

SEQ ID NO: 43637 - RNA, 20 nt, Artificial Sequence
  CIITA targeting sequence
uucaacagacuuugacccug

SEQ ID NO: 43638 - RNA, 20 nt, Artificial Sequence
  CIITA targeting sequence
cucauucaacagacuuugac

SEQ ID NO: 43639 - RNA, 20 nt, Artificial Sequence
  CIITA targeting sequence
aggcccuuugcauaugcacu

SEQ ID NO: 43640 - RNA, 20 nt, Artificial Sequence
  CIITA targeting sequence
ugugucuaggcccuuugcau

SEQ ID NO: 43641 - RNA, 20 nt, Artificial Sequence
  CIITA targeting sequence
cacuccugugucuaggcccu

SEQ ID NO: 43642 - RNA, 20 nt, Artificial Sequence
  CIITA targeting sequence
augcucaguacagauuuuga

SEQ ID NO: 43643 - RNA, 20 nt, Artificial Sequence
  CIITA targeting sequence
guacagauuuugaauggauu

SEQ ID NO: 43644 - RNA, 20 nt, Artificial Sequence
  CIITA targeting sequence
guacugagcauugauuguau

SEQ ID NO: 43645 - RNA, 20 nt, Artificial Sequence
  CIITA targeting sequence
aaaucuguacugagcauuga

SEQ ID NO: 43646 - RNA, 20 nt, Artificial Sequence
  CIITA targeting sequence
auucaaaaucuguacugagc

SEQ ID NO: 43647 - RNA, 20 nt, Artificial Sequence
  CIITA targeting sequence
auagguucuacuuuugagag

SEQ ID NO: 43648 - RNA, 20 nt, Artificial Sequence
  CIITA targeting sequence
acuuuugagaguuguucuca

SEQ ID NO: 43649 - RNA, 20 nt, Artificial Sequence
  CIITA targeting sequence
aaaguagaaccuauggaauc

SEQ ID NO: 43650 - RNA, 20 nt, Artificial Sequence
  CIITA targeting sequence
caaaaguagaaccuauggaa

SEQ ID NO: 43651 - RNA, 20 nt, Artificial Sequence
  CIITA targeting sequence
cagucuguucauguuucucu

SEQ ID NO: 43652 - RNA, 20 nt, Artificial Sequence
  CIITA targeting sequence
gucuguucauguuucucuau

SEQ ID NO: 43653 - RNA, 20 nt, Artificial Sequence
  CIITA targeting sequence
guucauguuucucuaucuuc

SEQ ID NO: 43654 - RNA, 20 nt, Artificial Sequence
  CIITA targeting sequence
uguuucucuaucuucacuaa

SEQ ID NO: 43655 - RNA, 20 nt, Artificial Sequence
  CIITA targeting sequence
cuaucuucacuaaacucccc

SEQ ID NO: 43656 - RNA, 20 nt, Artificial Sequence
  CIITA targeting sequence
aucuucacuaaacuccccuc

SEQ ID NO: 43657 - RNA, 20 nt, Artificial Sequence
  CIITA targeting sequence
ucacuaaacuccccucaucc

SEQ ID NO: 43658 - RNA, 20 nt, Artificial Sequence
  CIITA targeting sequence
cuaaacuccccucauccaag

SEQ ID NO: 43659 - RNA, 20 nt, Artificial Sequence
  CIITA targeting sequence
ccucauccaagccucuguca

SEQ ID NO: 43660 - RNA, 20 nt, Artificial Sequence
  CIITA targeting sequence
uccaagccucugucaccucu

SEQ ID NO: 43661 - RNA, 20 nt, Artificial Sequence
  CIITA targeting sequence
aagccucugucaccucuggc

SEQ ID NO: 43662 - RNA, 20 nt, Artificial Sequence
  CIITA targeting sequence
gucaccucuggccuggacaa

SEQ ID NO: 43663 - RNA, 20 nt, Artificial Sequence
  CIITA targeting sequence
ccucuggccuggacaacuaa

SEQ ID NO: 43664 - RNA, 20 nt, Artificial Sequence
  CIITA targeting sequence
ggccuggacaacuaacagca

SEQ ID NO: 43665 - RNA, 20 nt, Artificial Sequence
  CIITA targeting sequence
aggccagaggugacagaggc

SEQ ID NO: 43666 - RNA, 20 nt, Artificial Sequence
  CIITA targeting sequence
gaggugguggcccugcuucc

SEQ ID NO: 43667 - RNA, 20 nt, Artificial Sequence
  CIITA targeting sequence
gaugcuguuaguuguccagg

SEQ ID NO: 43668 - RNA, 20 nt, Artificial Sequence
  CIITA targeting sequence
ccucuuaccccucagcucau

SEQ ID NO: 43669 - RNA, 20 nt, Artificial Sequence
  CIITA targeting sequence
uaccccucagcucauucugu

SEQ ID NO: 43670 - RNA, 20 nt, Artificial Sequence
  CIITA targeting sequence
gcucauucuguccacaauug

SEQ ID NO: 43671 - RNA, 20 nt, Artificial Sequence
  CIITA targeting sequence
uucuguccacaauugccaga

SEQ ID NO: 43672 - RNA, 20 nt, Artificial Sequence
  CIITA targeting sequence
guccacaauugccagaguca

SEQ ID NO: 43673 - RNA, 20 nt, Artificial Sequence
  CIITA targeting sequence
acaauugccagagucauuuu

SEQ ID NO: 43674 - RNA, 20 nt, Artificial Sequence
  CIITA targeting sequence
ggcaauuguggacagaauga

SEQ ID NO: 43675 - RNA, 20 nt, Artificial Sequence
  CIITA targeting sequence
uuuuugcaaaaugggaaugg

SEQ ID NO: 43676 - RNA, 20 nt, Artificial Sequence
  CIITA targeting sequence
cauuuugcaaaaaugacucu

SEQ ID NO: 43677 - RNA, 20 nt, Artificial Sequence
  CIITA targeting sequence
cauucccauuuugcaaaaau

SEQ ID NO: 43678 - RNA, 20 nt, Artificial Sequence
  CIITA targeting sequence
ucuccugccuagaaccuucc

SEQ ID NO: 43679 - RNA, 20 nt, Artificial Sequence
  CIITA targeting sequence
ccugccuagaaccuuccaau

SEQ ID NO: 43680 - RNA, 20 nt, Artificial Sequence
  CIITA targeting sequence
ugccuagaaccuuccaaugg

SEQ ID NO: 43681 - RNA, 20 nt, Artificial Sequence
  CIITA targeting sequence
aggcaggagaugacacaauc

SEQ ID NO: 43682 - RNA, 20 nt, Artificial Sequence
  CIITA targeting sequence
aauggcuuuccacugcucuu

SEQ ID NO: 43683 - RNA, 20 nt, Artificial Sequence
  CIITA targeting sequence
acugcucuuggcuauggccu

SEQ ID NO: 43684 - RNA, 20 nt, Artificial Sequence
  CIITA targeting sequence
uggcuauggccuuccagguc

SEQ ID NO: 43685 - RNA, 20 nt, Artificial Sequence
  CIITA targeting sequence
agguccuccaugguauggcu

SEQ ID NO: 43686 - RNA, 20 nt, Artificial Sequence
  CIITA targeting sequence
uccaugguauggcucccacc

SEQ ID NO: 43687 - RNA, 20 nt, Artificial Sequence
  CIITA targeting sequence
augguauggcucccacccac

SEQ ID NO: 43688 - RNA, 20 nt, Artificial Sequence
  CIITA targeting sequence
cacccaccucacugaccuuu

SEQ ID NO: 43689 - RNA, 20 nt, Artificial Sequence
  CIITA targeting sequence
cugaccuuuccuggggcugu

SEQ ID NO: 43690 - RNA, 20 nt, Artificial Sequence
  CIITA targeting sequence
gugaggugggugggagccau

SEQ ID NO: 43691 - RNA, 20 nt, Artificial Sequence
  CIITA targeting sequence
uggggcuguucuccagccac

SEQ ID NO: 43692 - RNA, 20 nt, Artificial Sequence
  CIITA targeting sequence
ccagccacaugggccuccuu

SEQ ID NO: 43693 - RNA, 20 nt, Artificial Sequence
  CIITA targeting sequence
agccacaugggccuccuuuu

SEQ ID NO: 43694 - RNA, 20 nt, Artificial Sequence
  CIITA targeting sequence
uuuugguugcggaaaaacca

SEQ ID NO: 43695 - RNA, 20 nt, Artificial Sequence
  CIITA targeting sequence
gcaaccaaaaggaggcccau

SEQ ID NO: 43696 - RNA, 20 nt, Artificial Sequence
  CIITA targeting sequence
cucucaccugaaggucuugg

SEQ ID NO: 43697 - RNA, 20 nt, Artificial Sequence
  CIITA targeting sequence
cucaccugaaggucuuggca

SEQ ID NO: 43698 - RNA, 20 nt, Artificial Sequence
  CIITA targeting sequence
caccugaaggucuuggcacc

SEQ ID NO: 43699 - RNA, 20 nt, Artificial Sequence
  CIITA targeting sequence
ccugaaggucuuggcaccac

SEQ ID NO: 43700 - RNA, 20 nt, Artificial Sequence
  CIITA targeting sequence
ggugagagagaguugguuuu

SEQ ID NO: 43701 - RNA, 20 nt, Artificial Sequence
  CIITA targeting sequence
uggcaccacugauucccuca

SEQ ID NO: 43702 - RNA, 20 nt, Artificial Sequence
  CIITA targeting sequence
guggugccaagaccuucagg

SEQ ID NO: 43703 - RNA, 20 nt, Artificial Sequence
  CIITA targeting sequence
cucagccuggacugcuuuuc

SEQ ID NO: 43704 - RNA, 20 nt, Artificial Sequence
  CIITA targeting sequence
gccuggacugcuuuucucca

SEQ ID NO: 43705 - RNA, 20 nt, Artificial Sequence
  CIITA targeting sequence
aggcugagggaaucaguggu

SEQ ID NO: 43706 - RNA, 20 nt, Artificial Sequence
  CIITA targeting sequence
ccagauccuucuaucaaauu

SEQ ID NO: 43707 - RNA, 20 nt, Artificial Sequence
  CIITA targeting sequence
agauccuucuaucaaauuaa

SEQ ID NO: 43708 - RNA, 20 nt, Artificial Sequence
  CIITA targeting sequence
ggagaaaagcaguccaggcu

SEQ ID NO: 43709 - RNA, 20 nt, Artificial Sequence
  CIITA targeting sequence
uucuaucaaauuaaggcuca

SEQ ID NO: 43710 - RNA, 20 nt, Artificial Sequence
  CIITA targeting sequence
aucaaauuaaggcucagcuc

SEQ ID NO: 43711 - RNA, 20 nt, Artificial Sequence
  CIITA targeting sequence
aauuaaggcucagcucaaaa

SEQ ID NO: 43712 - RNA, 20 nt, Artificial Sequence
  CIITA targeting sequence
gcucaaaagcaucaucuccu

SEQ ID NO: 43713 - RNA, 20 nt, Artificial Sequence
  CIITA targeting sequence
aaagcaucaucuccuuagag

SEQ ID NO: 43714 - RNA, 20 nt, Artificial Sequence
  CIITA targeting sequence
ucuccuuagagaggcuuucu

SEQ ID NO: 43715 - RNA, 20 nt, Artificial Sequence
  CIITA targeting sequence
ccuuagagaggcuuucucug

SEQ ID NO: 43716 - RNA, 20 nt, Artificial Sequence
  CIITA targeting sequence
uuagagaggcuuucucugac

SEQ ID NO: 43717 - RNA, 20 nt, Artificial Sequence
  CIITA targeting sequence
aaggagaugaugcuuuugag

SEQ ID NO: 43718 - RNA, 20 nt, Artificial Sequence
  CIITA targeting sequence
cuaaggagaugaugcuuuug

SEQ ID NO: 43719 - RNA, 20 nt, Artificial Sequence
  CIITA targeting sequence
cugaccccucagcuaaagca

SEQ ID NO: 43720 - RNA, 20 nt, Artificial Sequence
  CIITA targeting sequence
gaccccucagcuaaagcagc

SEQ ID NO: 43721 - RNA, 20 nt, Artificial Sequence
  CIITA targeting sequence
gagaaagccucucuaaggag

SEQ ID NO: 43722 - RNA, 20 nt, Artificial Sequence
  CIITA targeting sequence
gcuaaagcagcccaccaucu

SEQ ID NO: 43723 - RNA, 20 nt, Artificial Sequence
  CIITA targeting sequence
cuauccuaccguuucacuuc

SEQ ID NO: 43724 - RNA, 20 nt, Artificial Sequence
  CIITA targeting sequence
auccuaccguuucacuucug

SEQ ID NO: 43725 - RNA, 20 nt, Artificial Sequence
  CIITA targeting sequence
uaccguuucacuucuguuuc

SEQ ID NO: 43726 - RNA, 20 nt, Artificial Sequence
  CIITA targeting sequence
cuucuguuucacuccauguc

SEQ ID NO: 43727 - RNA, 20 nt, Artificial Sequence
  CIITA targeting sequence
guuucacuccaugucuacac

SEQ ID NO: 43728 - RNA, 20 nt, Artificial Sequence
  CIITA targeting sequence
cuccaugucuacaccuacag

SEQ ID NO: 43729 - RNA, 20 nt, Artificial Sequence
  CIITA targeting sequence
augucuacaccuacagagac

SEQ ID NO: 43730 - RNA, 20 nt, Artificial Sequence
  CIITA targeting sequence
acaccuacagagaccgucua

SEQ ID NO: 43731 - RNA, 20 nt, Artificial Sequence
  CIITA targeting sequence
guagguguagacauggagug

SEQ ID NO: 43732 - RNA, 20 nt, Artificial Sequence
  CIITA targeting sequence
cuguagguguagacauggag

SEQ ID NO: 43733 - RNA, 20 nt, Artificial Sequence
  CIITA targeting sequence
acuagaggccaggcacaguu

SEQ ID NO: 43734 - RNA, 20 nt, Artificial Sequence
  CIITA targeting sequence
aguagacggucucuguaggu

SEQ ID NO: 43735 - RNA, 20 nt, Artificial Sequence
  CIITA targeting sequence
acacuuaaaacugugccugg

SEQ ID NO: 43736 - RNA, 20 nt, Artificial Sequence
  CIITA targeting sequence
ucaacacuuaaaacugugcc

SEQ ID NO: 43737 - RNA, 20 nt, Artificial Sequence
  CIITA targeting sequence
cugccauguccucaacacuu

SEQ ID NO: 43738 - RNA, 20 nt, Artificial Sequence
  CIITA targeting sequence
cuguuguguucacugccaug

SEQ ID NO: 43739 - RNA, 20 nt, Artificial Sequence
  CIITA targeting sequence
uguccuucuugccugccuuc

SEQ ID NO: 43740 - RNA, 20 nt, Artificial Sequence
  CIITA targeting sequence
uucuugccugccuucauagu

SEQ ID NO: 43741 - RNA, 20 nt, Artificial Sequence
  CIITA targeting sequence
ugccugccuucauaguuccg

SEQ ID NO: 43742 - RNA, 20 nt, Artificial Sequence
  CIITA targeting sequence
uaguuccgaaaaaaucugau

SEQ ID NO: 43743 - RNA, 20 nt, Artificial Sequence
  CIITA targeting sequence
gaaaaaaucugauucucuug

SEQ ID NO: 43744 - RNA, 20 nt, Artificial Sequence
  CIITA targeting sequence
gaacuaugaaggcaggcaag

SEQ ID NO: 43745 - RNA, 20 nt, Artificial Sequence
  CIITA targeting sequence
gauucucuuguuuggguucc

SEQ ID NO: 43746 - RNA, 20 nt, Artificial Sequence
  CIITA targeting sequence
gauuuuuucggaacuaugaa

SEQ ID NO: 43747 - RNA, 20 nt, Artificial Sequence
  CIITA targeting sequence
cuuguuuggguuccuacuag

SEQ ID NO: 43748 - RNA, 20 nt, Artificial Sequence
  CIITA targeting sequence
uguuuggguuccuacuaguc

SEQ ID NO: 43749 - RNA, 20 nt, Artificial Sequence
  CIITA targeting sequence
uacuagucuuccucaccaag

SEQ ID NO: 43750 - RNA, 20 nt, Artificial Sequence
  CIITA targeting sequence
uccucaccaagugccaaagg

SEQ ID NO: 43751 - RNA, 20 nt, Artificial Sequence
  CIITA targeting sequence
ucaccaagugccaaagggcc

SEQ ID NO: 43752 - RNA, 20 nt, Artificial Sequence
  CIITA targeting sequence
ccaagugccaaagggccaag

SEQ ID NO: 43753 - RNA, 20 nt, Artificial Sequence
  CIITA targeting sequence
gucuuguucacuguguucaa

SEQ ID NO: 43754 - RNA, 20 nt, Artificial Sequence
  CIITA targeting sequence
uguucacuguguucaaucac

SEQ ID NO: 43755 - RNA, 20 nt, Artificial Sequence
  CIITA targeting sequence
cuguguucaaucaccaggca

SEQ ID NO: 43756 - RNA, 20 nt, Artificial Sequence
  CIITA targeting sequence
aucaccaggcacuguacuga

SEQ ID NO: 43757 - RNA, 20 nt, Artificial Sequence
  CIITA targeting sequence
ccaggcacuguacugaacca

SEQ ID NO: 43758 - RNA, 20 nt, Artificial Sequence
  CIITA targeting sequence
guacagugccuggugauuga

SEQ ID NO: 43759 - RNA, 20 nt, Artificial Sequence
  CIITA targeting sequence
uucuguaaaagaacggacgg

SEQ ID NO: 43760 - RNA, 20 nt, Artificial Sequence
  CIITA targeting sequence
guaaaagaacggacggaugg

SEQ ID NO: 43761 - RNA, 20 nt, Artificial Sequence
  CIITA targeting sequence
uuuacagaaugaaugcuugu

SEQ ID NO: 43762 - RNA, 20 nt, Artificial Sequence
  CIITA targeting sequence
guucuuuuacagaaugaaug

SEQ ID NO: 43763 - RNA, 20 nt, Artificial Sequence
  CIITA targeting sequence
guccguucuuuuacagaaug

SEQ ID NO: 43764 - RNA, 20 nt, Artificial Sequence
  CIITA targeting sequence
auccguccguucuuuuacag

SEQ ID NO: 43765 - RNA, 20 nt, Artificial Sequence
  CIITA targeting sequence
ccagccugccugccugccug

SEQ ID NO: 43766 - RNA, 20 nt, Artificial Sequence
  CIITA targeting sequence
gcacaccuccccagccugcc

SEQ ID NO: 43767 - RNA, 20 nt, Artificial Sequence
  CIITA targeting sequence
cccuggcacuugguucucgc

SEQ ID NO: 43768 - RNA, 20 nt, Artificial Sequence
  CIITA targeting sequence
cgcuaagauguuacugagcu

SEQ ID NO: 43769 - RNA, 20 nt, Artificial Sequence
  CIITA targeting sequence
cuaagauguuacugagcuca

SEQ ID NO: 43770 - RNA, 20 nt, Artificial Sequence
  CIITA targeting sequence
uagcgagaaccaagugccag

SEQ ID NO: 43771 - RNA, 20 nt, Artificial Sequence
  CIITA targeting sequence
guaacaucuuagcgagaacc

SEQ ID NO: 43772 - RNA, 20 nt, Artificial Sequence
  CIITA targeting sequence
acugaagcuuuuucuucaaa

SEQ ID NO: 43773 - RNA, 20 nt, Artificial Sequence
  CIITA targeting sequence
guugagcucaguaacaucuu

SEQ ID NO: 43774 - RNA, 20 nt, Artificial Sequence
  CIITA targeting sequence
ucaaagaaaucucacuguga

SEQ ID NO: 43775 - RNA, 20 nt, Artificial Sequence
  CIITA targeting sequence
aagaaaucucacugugaacc

SEQ ID NO: 43776 - RNA, 20 nt, Artificial Sequence
  CIITA targeting sequence
uugaagaaaaagcuucaguu

SEQ ID NO: 43777 - RNA, 20 nt, Artificial Sequence
  CIITA targeting sequence
cacugugaacccauuaggag

SEQ ID NO: 43778 - RNA, 20 nt, Artificial Sequence
  CIITA targeting sequence
cugugaacccauuaggagag

SEQ ID NO: 43779 - RNA, 20 nt, Artificial Sequence
  CIITA targeting sequence
cagugagauuucuuugaaga

SEQ ID NO: 43780 - RNA, 20 nt, Artificial Sequence
  CIITA targeting sequence
uaauggguucacagugagau

SEQ ID NO: 43781 - RNA, 20 nt, Artificial Sequence
  CIITA targeting sequence
ccuaauggguucacagugag

SEQ ID NO: 43782 - RNA, 20 nt, Artificial Sequence
  CIITA targeting sequence
gccgccagcuaugcugucag

SEQ ID NO: 43783 - RNA, 20 nt, Artificial Sequence
  CIITA targeting sequence
guagguccuaccccacccug

SEQ ID NO: 43784 - RNA, 20 nt, Artificial Sequence
  CIITA targeting sequence
uaccccacccuguaccacca

SEQ ID NO: 43785 - RNA, 20 nt, Artificial Sequence
  CIITA targeting sequence
gcaacagacucaauguuugu

SEQ ID NO: 43786 - RNA, 20 nt, Artificial Sequence
  CIITA targeting sequence
guugcagauggugguacagg

SEQ ID NO: 43787 - RNA, 20 nt, Artificial Sequence
  CIITA targeting sequence
auguuugugucuccucaaac

SEQ ID NO: 43788 - RNA, 20 nt, Artificial Sequence
  CIITA targeting sequence
ccucaaacuucauauguuga

SEQ ID NO: 43789 - RNA, 20 nt, Artificial Sequence
  CIITA targeting sequence
ucaaacuucauauguugaaa

SEQ ID NO: 43790 - RNA, 20 nt, Artificial Sequence
  CIITA targeting sequence
aacuucauauguugaaacuc

SEQ ID NO: 43791 - RNA, 20 nt, Artificial Sequence
  CIITA targeting sequence
uauguugaaacucugauccc

SEQ ID NO: 43792 - RNA, 20 nt, Artificial Sequence
  CIITA targeting sequence
acauaugaaguuugaggaga

SEQ ID NO: 43793 - RNA, 20 nt, Artificial Sequence
  CIITA targeting sequence
gaucccaaaugaugguauug

SEQ ID NO: 43794 - RNA, 20 nt, Artificial Sequence
  CIITA targeting sequence
gaguuucaacauaugaaguu

SEQ ID NO: 43795 - RNA, 20 nt, Artificial Sequence
  CIITA targeting sequence
caaaugaugguauugcgggg

SEQ ID NO: 43796 - RNA, 20 nt, Artificial Sequence
  CIITA targeting sequence
uuugggaucagaguuucaac

SEQ ID NO: 43797 - RNA, 20 nt, Artificial Sequence
  CIITA targeting sequence
cuaaggccgcaccccgcaau

SEQ ID NO: 43798 - RNA, 20 nt, Artificial Sequence
  CIITA targeting sequence
ccucccuaaggccgcacccc

SEQ ID NO: 43799 - RNA, 20 nt, Artificial Sequence
  CIITA targeting sequence
cgaaggcagagccuucaugg

SEQ ID NO: 43800 - RNA, 20 nt, Artificial Sequence
  CIITA targeting sequence
ugaccuaaucaccucccuaa

SEQ ID NO: 43801 - RNA, 20 nt, Artificial Sequence
  CIITA targeting sequence
gccuucgugaccuaaucacc

SEQ ID NO: 43802 - RNA, 20 nt, Artificial Sequence
  CIITA targeting sequence
ugggugggauuaaugcccuu

SEQ ID NO: 43803 - RNA, 20 nt, Artificial Sequence
  CIITA targeting sequence
cacccaugaaggcucugccu

SEQ ID NO: 43804 - RNA, 20 nt, Artificial Sequence
  CIITA targeting sequence
uauaagggcauuaaucccac

SEQ ID NO: 43805 - RNA, 20 nt, Artificial Sequence
  CIITA targeting sequence
uacuguucuuauaagggcau

SEQ ID NO: 43806 - RNA, 20 nt, Artificial Sequence
  CIITA targeting sequence
cuuacuguucuuauaagggc

SEQ ID NO: 43807 - RNA, 20 nt, Artificial Sequence
  CIITA targeting sequence
cccagccuaugguguucugu

SEQ ID NO: 43808 - RNA, 20 nt, Artificial Sequence
  CIITA targeting sequence
guuauagcagacugaacuaa

SEQ ID NO: 43809 - RNA, 20 nt, Artificial Sequence
  CIITA targeting sequence
gcuauaacagaacaccauag

SEQ ID NO: 43810 - RNA, 20 nt, Artificial Sequence
  CIITA targeting sequence
gucugcuauaacagaacacc

SEQ ID NO: 43811 - RNA, 20 nt, Artificial Sequence
  CIITA targeting sequence
uaguucagucugcuauaaca

SEQ ID NO: 43812 - RNA, 20 nt, Artificial Sequence
  CIITA targeting sequence
gccugugguugucuuggcaa

SEQ ID NO: 43813 - RNA, 20 nt, Artificial Sequence
  CIITA targeting sequence
uggcaaagccagguaaugca

SEQ ID NO: 43814 - RNA, 20 nt, Artificial Sequence
  CIITA targeting sequence
ugcauuaccuggcuuugcca

SEQ ID NO: 43815 - RNA, 20 nt, Artificial Sequence
  CIITA targeting sequence
ccugcauuaccuggcuuugc

SEQ ID NO: 43816 - RNA, 20 nt, Artificial Sequence
  CIITA targeting sequence
accccucuccugcauuaccu

SEQ ID NO: 43817 - RNA, 20 nt, Artificial Sequence
  CIITA targeting sequence
gccugcuugcggugaauggc

SEQ ID NO: 43818 - RNA, 20 nt, Artificial Sequence
  CIITA targeting sequence
ccgcaagcaggcugagucca

SEQ ID NO: 43819 - RNA, 20 nt, Artificial Sequence
  CIITA targeting sequence
auuuuccuaaaggagcccuu

SEQ ID NO: 43820 - RNA, 20 nt, Artificial Sequence
  CIITA targeting sequence
uaaaggagcccuugcccacc

SEQ ID NO: 43821 - RNA, 20 nt, Artificial Sequence
  CIITA targeting sequence
uuuaggaaaauggacacuaa

SEQ ID NO: 43822 - RNA, 20 nt, Artificial Sequence
  CIITA targeting sequence
cagcauccccucuucauugc

SEQ ID NO: 43823 - RNA, 20 nt, Artificial Sequence
  CIITA targeting sequence
gcauccccucuucauugcca

SEQ ID NO: 43824 - RNA, 20 nt, Artificial Sequence
  CIITA targeting sequence
ccucuucauugccacuuaga

SEQ ID NO: 43825 - RNA, 20 nt, Artificial Sequence
  CIITA targeting sequence
ucauugccacuuagacccug

SEQ ID NO: 43826 - RNA, 20 nt, Artificial Sequence
  CIITA targeting sequence
uugccacuuagacccugugc

SEQ ID NO: 43827 - RNA, 20 nt, Artificial Sequence
  CIITA targeting sequence
aaguggcaaugaagagggga

SEQ ID NO: 43828 - RNA, 20 nt, Artificial Sequence
  CIITA targeting sequence
cugggcacagggucuaagug

SEQ ID NO: 43829 - RNA, 20 nt, Artificial Sequence
  CIITA targeting sequence
aguacuguccagucucaggg

SEQ ID NO: 43830 - RNA, 20 nt, Artificial Sequence
  CIITA targeting sequence
agucucaggggcugagccaa

SEQ ID NO: 43831 - RNA, 20 nt, Artificial Sequence
  CIITA targeting sequence
caggggcugagccaaggcgu

SEQ ID NO: 43832 - RNA, 20 nt, Artificial Sequence
  CIITA targeting sequence
ggggcugagccaaggcguuc

SEQ ID NO: 43833 - RNA, 20 nt, Artificial Sequence
  CIITA targeting sequence
gccccugagacuggacagua

SEQ ID NO: 43834 - RNA, 20 nt, Artificial Sequence
  CIITA targeting sequence
ugccugcccugugacccuca

SEQ ID NO: 43835 - RNA, 20 nt, Artificial Sequence
  CIITA targeting sequence
cagggcaggcaggaacgccu

SEQ ID NO: 43836 - RNA, 20 nt, Artificial Sequence
  CIITA targeting sequence
ccagaccuggcagcugccug

SEQ ID NO: 43837 - RNA, 20 nt, Artificial Sequence
  CIITA targeting sequence
ggugagggucacagggcagg

SEQ ID NO: 43838 - RNA, 20 nt, Artificial Sequence
  CIITA targeting sequence
ggcagcugccaggucuggug

SEQ ID NO: 43839 - RNA, 20 nt, Artificial Sequence
  CIITA targeting sequence
ggcucacguguucucucuaa

SEQ ID NO: 43840 - RNA, 20 nt, Artificial Sequence
  CIITA targeting sequence
cguguucucucuaauugagu

SEQ ID NO: 43841 - RNA, 20 nt, Artificial Sequence
  CIITA targeting sequence
cucuaauugagucuagcugc

SEQ ID NO: 43842 - RNA, 20 nt, Artificial Sequence
  CIITA targeting sequence
cuaauugagucuagcugccu

SEQ ID NO: 43843 - RNA, 20 nt, Artificial Sequence
  CIITA targeting sequence
aauugagucuagcugccucu

SEQ ID NO: 43844 - RNA, 20 nt, Artificial Sequence
  CIITA targeting sequence
auuagagagaacacgugagc

SEQ ID NO: 43845 - RNA, 20 nt, Artificial Sequence
  CIITA targeting sequence
agcugccucucuuccuugug

SEQ ID NO: 43846 - RNA, 20 nt, Artificial Sequence
  CIITA targeting sequence
cuuccuugugacuaugacca

SEQ ID NO: 43847 - RNA, 20 nt, Artificial Sequence
  CIITA targeting sequence
uccuugugacuaugaccaag

SEQ ID NO: 43848 - RNA, 20 nt, Artificial Sequence
  CIITA targeting sequence
uugugacuaugaccaagucu

SEQ ID NO: 43849 - RNA, 20 nt, Artificial Sequence
  CIITA targeting sequence
caaggaagagaggcagcuag

SEQ ID NO: 43850 - RNA, 20 nt, Artificial Sequence
  CIITA targeting sequence
uagucacaaggaagagaggc

SEQ ID NO: 43851 - RNA, 20 nt, Artificial Sequence
  CIITA targeting sequence
uacuccuuccuggaccuuca

SEQ ID NO: 43852 - RNA, 20 nt, Artificial Sequence
  CIITA targeting sequence
uuccuggaccuucauuuccc

SEQ ID NO: 43853 - RNA, 20 nt, Artificial Sequence
  CIITA targeting sequence
uggaccuucauuucccuacc

SEQ ID NO: 43854 - RNA, 20 nt, Artificial Sequence
  CIITA targeting sequence
aggaaggaguaagacuuggu

SEQ ID NO: 43855 - RNA, 20 nt, Artificial Sequence
  CIITA targeting sequence
uuucccuaccucucacauac

SEQ ID NO: 43856 - RNA, 20 nt, Artificial Sequence
  CIITA targeting sequence
cuaccucucacauacacagu

SEQ ID NO: 43857 - RNA, 20 nt, Artificial Sequence
  CIITA targeting sequence
cacauacacagugggcugga

SEQ ID NO: 43858 - RNA, 20 nt, Artificial Sequence
  CIITA targeting sequence
cauacacagugggcuggaug

SEQ ID NO: 43859 - RNA, 20 nt, Artificial Sequence
  CIITA targeting sequence
agcccacuguguaugugaga

SEQ ID NO: 43860 - RNA, 20 nt, Artificial Sequence
  CIITA targeting sequence
agcauccagcccacugugua

SEQ ID NO: 43861 - RNA, 20 nt, Artificial Sequence
  CIITA targeting sequence
cucgucacagccccaaagac

SEQ ID NO: 43862 - RNA, 20 nt, Artificial Sequence
  CIITA targeting sequence
ucacagccccaaagacagga

SEQ ID NO: 43863 - RNA, 20 nt, Artificial Sequence
  CIITA targeting sequence
cagccccaaagacaggacuu

SEQ ID NO: 43864 - RNA, 20 nt, Artificial Sequence
  CIITA targeting sequence
uuggggcugugacgagggag

SEQ ID NO: 43865 - RNA, 20 nt, Artificial Sequence
  CIITA targeting sequence
ugucuuuggggcugugacga

SEQ ID NO: 43866 - RNA, 20 nt, Artificial Sequence
  CIITA targeting sequence
aguccugucuuuggggcugu

SEQ ID NO: 43867 - RNA, 20 nt, Artificial Sequence
  CIITA targeting sequence
cagugcaaugacccuguggu

SEQ ID NO: 43868 - RNA, 20 nt, Artificial Sequence
  CIITA targeting sequence
gugcaaugacccuguggugc

SEQ ID NO: 43869 - RNA, 20 nt, Artificial Sequence
  CIITA targeting sequence
uugcacugagauggucaagu

SEQ ID NO: 43870 - RNA, 20 nt, Artificial Sequence
  CIITA targeting sequence
cccgaggaccuaagagcccc

SEQ ID NO: 43871 - RNA, 20 nt, Artificial Sequence
  CIITA targeting sequence
cgaggaccuaagagcccccu

SEQ ID NO: 43872 - RNA, 20 nt, Artificial Sequence
  CIITA targeting sequence
ggagaaggcaccacaggguc

SEQ ID NO: 43873 - RNA, 20 nt, Artificial Sequence
  CIITA targeting sequence
ucgggagaaggcaccacagg

SEQ ID NO: 43874 - RNA, 20 nt, Artificial Sequence
  CIITA targeting sequence
uagguccucgggagaaggca

SEQ ID NO: 43875 - RNA, 20 nt, Artificial Sequence
  CIITA targeting sequence
gggggcucuuagguccucgg

SEQ ID NO: 43876 - RNA, 20 nt, Artificial Sequence
  CIITA targeting sequence
gcaguguuugcaagcgcuca

SEQ ID NO: 43877 - RNA, 20 nt, Artificial Sequence
  CIITA targeting sequence
cuuugucugcaguguuugca

SEQ ID NO: 43878 - RNA, 20 nt, Artificial Sequence
  CIITA targeting sequence
cugccugccuguucugugaa

SEQ ID NO: 43879 - RNA, 20 nt, Artificial Sequence
  CIITA targeting sequence
gugaagggagccuacaaaac

SEQ ID NO: 43880 - RNA, 20 nt, Artificial Sequence
  CIITA targeting sequence
cagaacaggcaggcagggag

SEQ ID NO: 43881 - RNA, 20 nt, Artificial Sequence
  CIITA targeting sequence
cuucacagaacaggcaggca

SEQ ID NO: 43882 - RNA, 20 nt, Artificial Sequence
  CIITA targeting sequence
gagcugcagaacugaugagc

SEQ ID NO: 43883 - RNA, 20 nt, Artificial Sequence
  CIITA targeting sequence
gaacugcaggggcugccagu

SEQ ID NO: 43884 - RNA, 20 nt, Artificial Sequence
  CIITA targeting sequence
gcagcucagaacugcagggg

SEQ ID NO: 43885 - RNA, 20 nt, Artificial Sequence
  CIITA targeting sequence
guucugcagcucagaacugc

SEQ ID NO: 43886 - RNA, 20 nt, Artificial Sequence
  CIITA targeting sequence
ucaguucugcagcucagaac

SEQ ID NO: 43887 - RNA, 20 nt, Artificial Sequence
  CIITA targeting sequence
gggugccccagcucaucagu

SEQ ID NO: 43888 - RNA, 20 nt, Artificial Sequence
  CIITA targeting sequence
gguuucagggugccccagcu

SEQ ID NO: 43889 - RNA, 20 nt, Artificial Sequence
  CIITA targeting sequence
aaaauagcagcaaacccaag

SEQ ID NO: 43890 - RNA, 20 nt, Artificial Sequence
  CIITA targeting sequence
uuuuggccuuggguuugcug

SEQ ID NO: 43891 - RNA, 20 nt, Artificial Sequence
  CIITA targeting sequence
uugcuugcgauuucuccucu

SEQ ID NO: 43892 - RNA, 20 nt, Artificial Sequence
  CIITA targeting sequence
caagcaaagaagcccguacu

SEQ ID NO: 43893 - RNA, 20 nt, Artificial Sequence
  CIITA targeting sequence
ccucucacagcuuuggccua

SEQ ID NO: 43894 - RNA, 20 nt, Artificial Sequence
  CIITA targeting sequence
ucucacagcuuuggccuaga

SEQ ID NO: 43895 - RNA, 20 nt, Artificial Sequence
  CIITA targeting sequence
cacagcuuuggccuagagcc

SEQ ID NO: 43896 - RNA, 20 nt, Artificial Sequence
  CIITA targeting sequence
cagcuuuggccuagagcccc

SEQ ID NO: 43897 - RNA, 20 nt, Artificial Sequence
  CIITA targeting sequence
aggccaaagcugugagagga

SEQ ID NO: 43898 - RNA, 20 nt, Artificial Sequence
  CIITA targeting sequence
ccacccagcuaccccaaggg

SEQ ID NO: 43899 - RNA, 20 nt, Artificial Sequence
  CIITA targeting sequence
ccuuuguacuguggcccuug

SEQ ID NO: 43900 - RNA, 20 nt, Artificial Sequence
  CIITA targeting sequence
ugccuggcucccugugucuu

SEQ ID NO: 43901 - RNA, 20 nt, Artificial Sequence
  CIITA targeting sequence
cugugucuucugacaccccu

SEQ ID NO: 43902 - RNA, 20 nt, Artificial Sequence
  CIITA targeting sequence
ucugacaccccuaaaucuuu

SEQ ID NO: 43903 - RNA, 20 nt, Artificial Sequence
  CIITA targeting sequence
gacaccccuaaaucuuuauc

SEQ ID NO: 43904 - RNA, 20 nt, Artificial Sequence
  CIITA targeting sequence
gaagacacagggagccaggc

SEQ ID NO: 43905 - RNA, 20 nt, Artificial Sequence
  CIITA targeting sequence
uuauccuucuaggacaagcg

SEQ ID NO: 43906 - RNA, 20 nt, Artificial Sequence
  CIITA targeting sequence
uucuaggacaagcgagaauc

SEQ ID NO: 43907 - RNA, 20 nt, Artificial Sequence
  CIITA targeting sequence
aggacaagcgagaauccccc

SEQ ID NO: 43908 - RNA, 20 nt, Artificial Sequence
  CIITA targeting sequence
uagaaggauaaagauuuagg

SEQ ID NO: 43909 - RNA, 20 nt, Artificial Sequence
  CIITA targeting sequence
cuuguccuagaaggauaaag

SEQ ID NO: 43910 - RNA, 20 nt, Artificial Sequence
  CIITA targeting sequence
cgcuuguccuagaaggauaa

SEQ ID NO: 43911 - RNA, 20 nt, Artificial Sequence
  CIITA targeting sequence
cccaaaagccaaggucauca

SEQ ID NO: 43912 - RNA, 20 nt, Artificial Sequence
  CIITA targeting sequence
ucaucaagccaggaugagga

SEQ ID NO: 43913 - RNA, 20 nt, Artificial Sequence
  CIITA targeting sequence
ucaagccaggaugaggacug

SEQ ID NO: 43914 - RNA, 20 nt, Artificial Sequence
  CIITA targeting sequence
agccaggaugaggacuggag

SEQ ID NO: 43915 - RNA, 20 nt, Artificial Sequence
  CIITA targeting sequence
uggcuugaugaugaccuugg

SEQ ID NO: 43916 - RNA, 20 nt, Artificial Sequence
  CIITA targeting sequence
uccuggcuugaugaugaccu

SEQ ID NO: 43917 - RNA, 20 nt, Artificial Sequence
  CIITA targeting sequence
ucauccuggcuugaugauga

SEQ ID NO: 43918 - RNA, 20 nt, Artificial Sequence
  CIITA targeting sequence
aguccucauccuggcuugau

SEQ ID NO: 43919 - RNA, 20 nt, Artificial Sequence
  CIITA targeting sequence
uccaguccucauccuggcuu

SEQ ID NO: 43920 - RNA, 20 nt, Artificial Sequence
  CIITA targeting sequence
uccuccaguccucauccugg

SEQ ID NO: 43921 - RNA, 20 nt, Artificial Sequence
  CIITA targeting sequence
gcuccuccuccaguccucau

SEQ ID NO: 43922 - RNA, 20 nt, Artificial Sequence
  CIITA targeting sequence
gccucaaauggauuugggag

SEQ ID NO: 43923 - RNA, 20 nt, Artificial Sequence
  CIITA targeting sequence
aauggauuugggagcgaagg

SEQ ID NO: 43924 - RNA, 20 nt, Artificial Sequence
  CIITA targeting sequence
auuugaggcagagcugucag

SEQ ID NO: 43925 - RNA, 20 nt, Artificial Sequence
  CIITA targeting sequence
caaauccauuugaggcagag

SEQ ID NO: 43926 - RNA, 20 nt, Artificial Sequence
  CIITA targeting sequence
cucccaaauccauuugaggc

SEQ ID NO: 43927 - RNA, 20 nt, Artificial Sequence
  CIITA targeting sequence
auaagcuuuggggguaaguc

SEQ ID NO: 43928 - RNA, 20 nt, Artificial Sequence
  CIITA targeting sequence
cagagcuaccccaaauguaa

SEQ ID NO: 43929 - RNA, 20 nt, Artificial Sequence
  CIITA targeting sequence
gugacuuacccccaaagcuu

SEQ ID NO: 43930 - RNA, 20 nt, Artificial Sequence
  CIITA targeting sequence
cggggucuccuuccuuuuca

SEQ ID NO: 43931 - RNA, 20 nt, Artificial Sequence
  CIITA targeting sequence
gggucuccuuccuuuucacc

SEQ ID NO: 43932 - RNA, 20 nt, Artificial Sequence
  CIITA targeting sequence
ccuuccuuuucaccagcugu

SEQ ID NO: 43933 - RNA, 20 nt, Artificial Sequence
  CIITA targeting sequence
uuccuuuucaccagcugucc

SEQ ID NO: 43934 - RNA, 20 nt, Artificial Sequence
  CIITA targeting sequence
uuuucaccagcuguccccuu

SEQ ID NO: 43935 - RNA, 20 nt, Artificial Sequence
  CIITA targeting sequence
ccagcuguccccuuugcugg

SEQ ID NO: 43936 - RNA, 20 nt, Artificial Sequence
  CIITA targeting sequence
ccuuugcuggaggaagcuuu

SEQ ID NO: 43937 - RNA, 20 nt, Artificial Sequence
  CIITA targeting sequence
agcaaaggggacagcuggug

SEQ ID NO: 43938 - RNA, 20 nt, Artificial Sequence
  CIITA targeting sequence
uccagcaaaggggacagcug

SEQ ID NO: 43939 - RNA, 20 nt, Artificial Sequence
  CIITA targeting sequence
agcccaaacgaagggcuuaa

SEQ ID NO: 43940 - RNA, 20 nt, Artificial Sequence
  CIITA targeting sequence
uuugggcuggaaagcuuccu

SEQ ID NO: 43941 - RNA, 20 nt, Artificial Sequence
  CIITA targeting sequence
uaagcccuucguuugggcug

SEQ ID NO: 43942 - RNA, 20 nt, Artificial Sequence
  CIITA targeting sequence
ucuuaagcccuucguuuggg

SEQ ID NO: 43943 - RNA, 20 nt, Artificial Sequence
  CIITA targeting sequence
ggccauuccuggcauccagu

SEQ ID NO: 43944 - RNA, 20 nt, Artificial Sequence
  CIITA targeting sequence
uggcauccaguuagaccugg

SEQ ID NO: 43945 - RNA, 20 nt, Artificial Sequence
  CIITA targeting sequence
aguuagaccuggaggaggug

SEQ ID NO: 43946 - RNA, 20 nt, Artificial Sequence
  CIITA targeting sequence
aacuggaugccaggaauggc

SEQ ID NO: 43947 - RNA, 20 nt, Artificial Sequence
  CIITA targeting sequence
aggucuaacuggaugccagg

SEQ ID NO: 43948 - RNA, 20 nt, Artificial Sequence
  CIITA targeting sequence
uccaggucuaacuggaugcc

SEQ ID NO: 43949 - RNA, 20 nt, Artificial Sequence
  CIITA targeting sequence
ccuccuccaggucuaacugg

SEQ ID NO: 43950 - RNA, 20 nt, Artificial Sequence
  CIITA targeting sequence
guucaccuccuccaggucua

SEQ ID NO: 43951 - RNA, 20 nt, Artificial Sequence
  CIITA targeting sequence
uccguucaccuccuccaggu

SEQ ID NO: 43952 - RNA, 20 nt, Artificial Sequence
  CIITA targeting sequence
ccuccguucaccuccuccag

SEQ ID NO: 43953 - RNA, 20 nt, Artificial Sequence
  CIITA targeting sequence
ggcuucuccuccguucaccu

SEQ ID NO: 43954 - RNA, 20 nt, Artificial Sequence
  CIITA targeting sequence
cucaggcuucuccuccguuc

SEQ ID NO: 43955 - RNA, 20 nt, Artificial Sequence
  CIITA targeting sequence
ggccugggaauuccucccuc

SEQ ID NO: 43956 - RNA, 20 nt, Artificial Sequence
  CIITA targeting sequence
caggccggauacacaccccu

SEQ ID NO: 43957 - RNA, 20 nt, Artificial Sequence
  CIITA targeting sequence
ucccucucccuugcuagcgc

SEQ ID NO: 43958 - RNA, 20 nt, Artificial Sequence
  CIITA targeting sequence
cucucccuugcuagcgcccc

SEQ ID NO: 43959 - RNA, 20 nt, Artificial Sequence
  CIITA targeting sequence
cccuugcuagcgccccaacc

SEQ ID NO: 43960 - RNA, 20 nt, Artificial Sequence
  CIITA targeting sequence
cuugcuagcgccccaacccg

SEQ ID NO: 43961 - RNA, 20 nt, Artificial Sequence
  CIITA targeting sequence
uccuguucagagagggcacu

SEQ ID NO: 43962 - RNA, 20 nt, Artificial Sequence
  CIITA targeting sequence
uguucagagagggcacuuac

SEQ ID NO: 43963 - RNA, 20 nt, Artificial Sequence
  CIITA targeting sequence
gagagggcacuuacaggccu

SEQ ID NO: 43964 - RNA, 20 nt, Artificial Sequence
  CIITA targeting sequence
gaacaggaugagggcggguu

SEQ ID NO: 43965 - RNA, 20 nt, Artificial Sequence
  CIITA targeting sequence
cugaacaggaugagggcggg

SEQ ID NO: 43966 - RNA, 20 nt, Artificial Sequence
  CIITA targeting sequence
gaggcaggggagggucuccu

SEQ ID NO: 43967 - RNA, 20 nt, Artificial Sequence
  CIITA targeting sequence
gaggccuguaagugcccucu

SEQ ID NO: 43968 - RNA, 20 nt, Artificial Sequence
  CIITA targeting sequence
ccugccuccgaggccuguaa

SEQ ID NO: 43969 - RNA, 20 nt, Artificial Sequence
  CIITA targeting sequence
ccuccuggggaaccaucccc

SEQ ID NO: 43970 - RNA, 20 nt, Artificial Sequence
  CIITA targeting sequence
uccuggggaaccauccccgu

SEQ ID NO: 43971 - RNA, 20 nt, Artificial Sequence
  CIITA targeting sequence
uggggaaccauccccgucca

SEQ ID NO: 43972 - RNA, 20 nt, Artificial Sequence
  CIITA targeting sequence
ccaggaggagacccuccccu

SEQ ID NO: 43973 - RNA, 20 nt, Artificial Sequence
  CIITA targeting sequence
ccguccagauggugccccca

SEQ ID NO: 43974 - RNA, 20 nt, Artificial Sequence
  CIITA targeting sequence
agauggugcccccaaccagc

SEQ ID NO: 43975 - RNA, 20 nt, Artificial Sequence
  CIITA targeting sequence
ggacggggaugguuccccag

SEQ ID NO: 43976 - RNA, 20 nt, Artificial Sequence
  CIITA targeting sequence
ugccgccgcagcugguuggg

SEQ ID NO: 43977 - RNA, 20 nt, Artificial Sequence
  CIITA targeting sequence
gggcggcugguccagggcau

SEQ ID NO: 43978 - RNA, 20 nt, Artificial Sequence
  CIITA targeting sequence
agggcauggguugcggaucg

SEQ ID NO: 43979 - RNA, 20 nt, Artificial Sequence
  CIITA targeting sequence
gcaacccaugcccuggacca

SEQ ID NO: 43980 - RNA, 20 nt, Artificial Sequence
  CIITA targeting sequence
uguagggaagaggggaacag

SEQ ID NO: 43981 - RNA, 20 nt, Artificial Sequence
  CIITA targeting sequence
cuacacgauccgcaacccau

SEQ ID NO: 43982 - RNA, 20 nt, Artificial Sequence
  CIITA targeting sequence
ucccuacacgauccgcaacc

SEQ ID NO: 43983 - RNA, 20 nt, Artificial Sequence
  CIITA targeting sequence
ccucuucccuacacgauccg

SEQ ID NO: 43984 - RNA, 20 nt, Artificial Sequence
  CIITA targeting sequence
agacccuacuccaaguacgc

SEQ ID NO: 43985 - RNA, 20 nt, Artificial Sequence
  CIITA targeting sequence
acugcuguuccccucuuccc

SEQ ID NO: 43986 - RNA, 20 nt, Artificial Sequence
  CIITA targeting sequence
cgacugcuguuccccucuuc

SEQ ID NO: 43987 - RNA, 20 nt, Artificial Sequence
  CIITA targeting sequence
aaguacgcaucaaagacguc

SEQ ID NO: 43988 - RNA, 20 nt, Artificial Sequence
  CIITA targeting sequence
aagacgucgagcuccgaguc

SEQ ID NO: 43989 - RNA, 20 nt, Artificial Sequence
  CIITA targeting sequence
uugaugcguacuuggaguag

SEQ ID NO: 43990 - RNA, 20 nt, Artificial Sequence
  CIITA targeting sequence
agcuccgagucagcaucgua

SEQ ID NO: 43991 - RNA, 20 nt, Artificial Sequence
  CIITA targeting sequence
acgucuuugaugcguacuug

SEQ ID NO: 43992 - RNA, 20 nt, Artificial Sequence
  CIITA targeting sequence
gagucagcaucguaaaggcc

SEQ ID NO: 43993 - RNA, 20 nt, Artificial Sequence
  CIITA targeting sequence
gagcucgacgucuuugaugc

SEQ ID NO: 43994 - RNA, 20 nt, Artificial Sequence
  CIITA targeting sequence
gcaucguaaaggcccgagcc

SEQ ID NO: 43995 - RNA, 20 nt, Artificial Sequence
  CIITA targeting sequence
uaaaggcccgagccgggguc

SEQ ID NO: 43996 - RNA, 20 nt, Artificial Sequence
  CIITA targeting sequence
ggccuuuacgaugcugacuc

SEQ ID NO: 43997 - RNA, 20 nt, Artificial Sequence
  CIITA targeting sequence
gagagcacgccgagguccac

SEQ ID NO: 43998 - RNA, 20 nt, Artificial Sequence
  CIITA targeting sequence
gaccccggcucgggccuuua

SEQ ID NO: 43999 - RNA, 20 nt, Artificial Sequence
  CIITA targeting sequence
ccgaccccggcucgggccuu

SEQ ID NO: 44000 - RNA, 20 nt, Artificial Sequence
  CIITA targeting sequence
gcgugcucuccgaccccggc

SEQ ID NO: 44001 - RNA, 20 nt, Artificial Sequence
  CIITA targeting sequence
acgagcgccugguccauguc

SEQ ID NO: 44002 - RNA, 20 nt, Artificial Sequence
  CIITA targeting sequence
uggaccucggcgugcucucc

SEQ ID NO: 44003 - RNA, 20 nt, Artificial Sequence
  CIITA targeting sequence
auguccucgggcaggaagac

SEQ ID NO: 44004 - RNA, 20 nt, Artificial Sequence
  CIITA targeting sequence
ucgggcaggaagacgaggcc

SEQ ID NO: 44005 - RNA, 20 nt, Artificial Sequence
  CIITA targeting sequence
ggcaggaagacgaggcccac

SEQ ID NO: 44006 - RNA, 20 nt, Artificial Sequence
  CIITA targeting sequence
ugcccgaggacauggaccag

SEQ ID NO: 44007 - RNA, 20 nt, Artificial Sequence
  CIITA targeting sequence
uccugcccgaggacauggac

SEQ ID NO: 44008 - RNA, 20 nt, Artificial Sequence
  CIITA targeting sequence
ucuuccugcccgaggacaug

SEQ ID NO: 44009 - RNA, 20 nt, Artificial Sequence
  CIITA targeting sequence
acgugggccucgucuuccug

SEQ ID NO: 44010 - RNA, 20 nt, Artificial Sequence
  CIITA targeting sequence
ucaacgugggccucgucuuc

SEQ ID NO: 44011 - RNA, 20 nt, Artificial Sequence
  CIITA targeting sequence
uccucaacgugggccucguc

SEQ ID NO: 44012 - RNA, 20 nt, Artificial Sequence
  CIITA targeting sequence
augaggaaggcguaguacag

SEQ ID NO: 44013 - RNA, 20 nt, Artificial Sequence
  CIITA targeting sequence
uggaguacaucguccucaac

SEQ ID NO: 44014 - RNA, 20 nt, Artificial Sequence
  CIITA targeting sequence
ucauggaguacaucguccuc

SEQ ID NO: 44015 - RNA, 20 nt, Artificial Sequence
  CIITA targeting sequence
uguacuacgccuuccucaug

SEQ ID NO: 44016 - RNA, 20 nt, Artificial Sequence
  CIITA targeting sequence
gcacauugacgaagaacagg

SEQ ID NO: 44017 - RNA, 20 nt, Artificial Sequence
  CIITA targeting sequence
augugcugauccuguacuac

SEQ ID NO: 44018 - RNA, 20 nt, Artificial Sequence
  CIITA targeting sequence
ucaaugugcugauccuguac

SEQ ID NO: 44019 - RNA, 20 nt, Artificial Sequence
  CIITA targeting sequence
ucgucaaugugcugauccug

SEQ ID NO: 44020 - RNA, 20 nt, Artificial Sequence
  CIITA targeting sequence
acgugggccuguucuucguc

SEQ ID NO: 44021 - RNA, 20 nt, Artificial Sequence
  CIITA targeting sequence
auguucuacgugggccuguu

SEQ ID NO: 44022 - RNA, 20 nt, Artificial Sequence
  CIITA targeting sequence
ccuacgugccgccgccgcug

SEQ ID NO: 44023 - RNA, 20 nt, Artificial Sequence
  CIITA targeting sequence
aggugggccgcgacccgggc

SEQ ID NO: 44024 - RNA, 20 nt, Artificial Sequence
  CIITA targeting sequence
cggcccaccuggacgcacug

SEQ ID NO: 44025 - RNA, 20 nt, Artificial Sequence
  CIITA targeting sequence
gcgcccgggucgcggcccac

SEQ ID NO: 44026 - RNA, 20 nt, Artificial Sequence
  CIITA targeting sequence
ccgggccgccgcccuugcca

SEQ ID NO: 44027 - RNA, 20 nt, Artificial Sequence
  CIITA targeting sequence
cggcgaacucagccgcugcg

SEQ ID NO: 44028 - RNA, 20 nt, Artificial Sequence
  CIITA targeting sequence
ccgggaucgccgggccgccg

SEQ ID NO: 44029 - RNA, 20 nt, Artificial Sequence
  CIITA targeting sequence
gccgcugcggcgcccgggcg

SEQ ID NO: 44030 - RNA, 20 nt, Artificial Sequence
  CIITA targeting sequence
ccggccgcccgggcgccgca

SEQ ID NO: 44031 - RNA, 20 nt, Artificial Sequence
  CIITA targeting sequence
agggguacccuggagcccga

SEQ ID NO: 44032 - RNA, 20 nt, Artificial Sequence
  CIITA targeting sequence
aggguaccccuggauggcug

SEQ ID NO: 44033 - RNA, 20 nt, Artificial Sequence
  CIITA targeting sequence
ggcuccaggguaccccugga

SEQ ID NO: 44034 - RNA, 20 nt, Artificial Sequence
  CIITA targeting sequence
gucgggcuccaggguacccc

SEQ ID NO: 44035 - RNA, 20 nt, Artificial Sequence
  CIITA targeting sequence
agauguccccuggcaauugc

SEQ ID NO: 44036 - RNA, 20 nt, Artificial Sequence
  CIITA targeting sequence
ggagcccggcccugcuucug

SEQ ID NO: 44037 - RNA, 20 nt, Artificial Sequence
  CIITA targeting sequence
ccuggcaauugcgccccgac

SEQ ID NO: 44038 - RNA, 20 nt, Artificial Sequence
  CIITA targeting sequence
gggcgcaauugccaggggac

SEQ ID NO: 44039 - RNA, 20 nt, Artificial Sequence
  CIITA targeting sequence
ggggucggggcgcaauugcc

SEQ ID NO: 44040 - RNA, 20 nt, Artificial Sequence
  CIITA targeting sequence
ccgcaccccgagaugugccc

SEQ ID NO: 44041 - RNA, 20 nt, Artificial Sequence
  CIITA targeting sequence
gggugcggugacccgcccgg

SEQ ID NO: 44042 - RNA, 20 nt, Artificial Sequence
  CIITA targeting sequence
cggggugcggugacccgccc

SEQ ID NO: 44043 - RNA, 20 nt, Artificial Sequence
  CIITA targeting sequence
uugggggcacaucucggggu

SEQ ID NO: 44044 - RNA, 20 nt, Artificial Sequence
  CIITA targeting sequence
cucgaccgcccgggcggcga

SEQ ID NO: 44045 - RNA, 20 nt, Artificial Sequence
  CIITA targeting sequence
cgaccgcccgggcggcgagg

SEQ ID NO: 44046 - RNA, 20 nt, Artificial Sequence
  CIITA targeting sequence
accgcccgggcggcgaggcg

SEQ ID NO: 44047 - RNA, 20 nt, Artificial Sequence
  CIITA targeting sequence
agagauccuugggggcacau

SEQ ID NO: 44048 - RNA, 20 nt, Artificial Sequence
  CIITA targeting sequence
ccgcccgggcggucgagaga

SEQ ID NO: 44049 - RNA, 20 nt, Artificial Sequence
  CIITA targeting sequence
ggggggcccgccucgccgcc

SEQ ID NO: 44050 - RNA, 20 nt, Artificial Sequence
  CIITA targeting sequence
cucguggcgccucccuggcg

SEQ ID NO: 44051 - RNA, 20 nt, Artificial Sequence
  CIITA targeting sequence
uggcgccucccuggcgcucg

SEQ ID NO: 44052 - RNA, 20 nt, Artificial Sequence
  CIITA targeting sequence
cuggcgcucgcagggccucg

SEQ ID NO: 44053 - RNA, 20 nt, Artificial Sequence
  CIITA targeting sequence
cagggccucgcagagccggu

SEQ ID NO: 44054 - RNA, 20 nt, Artificial Sequence
  CIITA targeting sequence
cagagccgguggggauccca

SEQ ID NO: 44055 - RNA, 20 nt, Artificial Sequence
  CIITA targeting sequence
gcgaggcccugcgagcgcca

SEQ ID NO: 44056 - RNA, 20 nt, Artificial Sequence
  CIITA targeting sequence
ccaccggcucugcgaggccc

SEQ ID NO: 44057 - RNA, 20 nt, Artificial Sequence
  CIITA targeting sequence
caccgcggcucagugucuag

SEQ ID NO: 44058 - RNA, 20 nt, Artificial Sequence
  CIITA targeting sequence
gugucuagggccggucccgg

SEQ ID NO: 44059 - RNA, 20 nt, Artificial Sequence
  CIITA targeting sequence
agggccggucccggcagccu

SEQ ID NO: 44060 - RNA, 20 nt, Artificial Sequence
  CIITA targeting sequence
cggcagccuucucucccgcc

SEQ ID NO: 44061 - RNA, 20 nt, Artificial Sequence
  CIITA targeting sequence
cucccgccccgccccgcagg

SEQ ID NO: 44062 - RNA, 20 nt, Artificial Sequence
  CIITA targeting sequence
cccgccccgccccgcagguc

SEQ ID NO: 44063 - RNA, 20 nt, Artificial Sequence
  CIITA targeting sequence
cgccccgccccgcagguccu

SEQ ID NO: 44064 - RNA, 20 nt, Artificial Sequence
  CIITA targeting sequence
ucgcgcaccccccgcgcccc

SEQ ID NO: 44065 - RNA, 20 nt, Artificial Sequence
  CIITA targeting sequence
cgcaccccccgcgcccccgc

SEQ ID NO: 44066 - RNA, 20 nt, Artificial Sequence
  CIITA targeting sequence
cgguggcgcucggagcuccg

SEQ ID NO: 44067 - RNA, 20 nt, Artificial Sequence
  CIITA targeting sequence
gagcuccgccucccgagggg

SEQ ID NO: 44068 - RNA, 20 nt, Artificial Sequence
  CIITA targeting sequence
gagcgccaccgggagggcua

SEQ ID NO: 44069 - RNA, 20 nt, Artificial Sequence
  CIITA targeting sequence
gccucccgaggggccccgag

SEQ ID NO: 44070 - RNA, 20 nt, Artificial Sequence
  CIITA targeting sequence
cgaggggccccgagcucauu

SEQ ID NO: 44071 - RNA, 20 nt, Artificial Sequence
  CIITA targeting sequence
ggaggcggagcuccgagcgc

SEQ ID NO: 44072 - RNA, 20 nt, Artificial Sequence
  CIITA targeting sequence
gggccccucgggaggcggag

SEQ ID NO: 44073 - RNA, 20 nt, Artificial Sequence
  CIITA targeting sequence
uuggcaggccgcccccugca

SEQ ID NO: 44074 - RNA, 20 nt, Artificial Sequence
  CIITA targeting sequence
acgcccgcgcugauuggcuc

SEQ ID NO: 44075 - RNA, 20 nt, Artificial Sequence
  CIITA targeting sequence
gcgcgggcguugagccggcc

SEQ ID NO: 44076 - RNA, 20 nt, Artificial Sequence
  CIITA targeting sequence
ggccgccagggggcggguac

SEQ ID NO: 44077 - RNA, 20 nt, Artificial Sequence
  CIITA targeting sequence
cuccgccccucggggcccua

SEQ ID NO: 44078 - RNA, 20 nt, Artificial Sequence
  CIITA targeting sequence
gccccucggggcccuagcgu

SEQ ID NO: 44079 - RNA, 20 nt, Artificial Sequence
  CIITA targeting sequence
gggcccuagcgucugaguug

SEQ ID NO: 44080 - RNA, 20 nt, Artificial Sequence
  CIITA targeting sequence
gaguugcuuuccugguucgg

SEQ ID NO: 44081 - RNA, 20 nt, Artificial Sequence
  CIITA targeting sequence
gacgcuagggccccgagggg

SEQ ID NO: 44082 - RNA, 20 nt, Artificial Sequence
  CIITA targeting sequence
ugguucgggucugcccucag

SEQ ID NO: 44083 - RNA, 20 nt, Artificial Sequence
  CIITA targeting sequence
ggucugcccucagaucucaa

SEQ ID NO: 44084 - RNA, 20 nt, Artificial Sequence
  CIITA targeting sequence
gcccucagaucucaaaucga

SEQ ID NO: 44085 - RNA, 20 nt, Artificial Sequence
  CIITA targeting sequence
gaucucaaaucgaauucgcu

SEQ ID NO: 44086 - RNA, 20 nt, Artificial Sequence
  CIITA targeting sequence
gagggcagacccgaaccagg

SEQ ID NO: 44087 - RNA, 20 nt, Artificial Sequence
  CIITA targeting sequence
caaaucgaauucgcucugcg

SEQ ID NO: 44088 - RNA, 20 nt, Artificial Sequence
  CIITA targeting sequence
aaucgaauucgcucugcgua

SEQ ID NO: 44089 - RNA, 20 nt, Artificial Sequence
  CIITA targeting sequence
aauucgcucugcguaucgaa

SEQ ID NO: 44090 - RNA, 20 nt, Artificial Sequence
  CIITA targeting sequence
auuugagaucugagggcaga

SEQ ID NO: 44091 - RNA, 20 nt, Artificial Sequence
  CIITA targeting sequence
cucugcguaucgaauagggg

SEQ ID NO: 44092 - RNA, 20 nt, Artificial Sequence
  CIITA targeting sequence
gcguaucgaauagggggagg

SEQ ID NO: 44093 - RNA, 20 nt, Artificial Sequence
  CIITA targeting sequence
aauagggggagguaaaagag

SEQ ID NO: 44094 - RNA, 20 nt, Artificial Sequence
  CIITA targeting sequence
auacgcagagcgaauucgau

SEQ ID NO: 44095 - RNA, 20 nt, Artificial Sequence
  CIITA targeting sequence
cccuauucgauacgcagagc

SEQ ID NO: 44096 - RNA, 20 nt, Artificial Sequence
  CIITA targeting sequence
uuuaccucccccuauucgau

SEQ ID NO: 44097 - RNA, 20 nt, Artificial Sequence
  CIITA targeting sequence
cuuuuaccucccccuauucg

SEQ ID NO: 44098 - RNA, 20 nt, Artificial Sequence
  CIITA targeting sequence
gucucuuuuaccucccccua

SEQ ID NO: 44099 - RNA, 20 nt, Artificial Sequence
  CIITA targeting sequence
aaccuagacauaaugcuaag

SEQ ID NO: 44100 - RNA, 20 nt, Artificial Sequence
  CIITA targeting sequence
agguuugaacuguguucagu

SEQ ID NO: 44101 - RNA, 20 nt, Artificial Sequence
  CIITA targeting sequence
gcuuuugcggccuuagcauu

SEQ ID NO: 44102 - RNA, 20 nt, Artificial Sequence
  CIITA targeting sequence
uucggcuuuugcggccuuag

SEQ ID NO: 44103 - RNA, 20 nt, Artificial Sequence
  CIITA targeting sequence
uugggacuccguuucuccuu

SEQ ID NO: 44104 - RNA, 20 nt, Artificial Sequence
  CIITA targeting sequence
caaagaggcaugcagcaagg

SEQ ID NO: 44105 - RNA, 20 nt, Artificial Sequence
  CIITA targeting sequence
guuucuccuuuaaaaggagg

SEQ ID NO: 44106 - RNA, 20 nt, Artificial Sequence
  CIITA targeting sequence
ccuuuaaaaggaggcggggu

SEQ ID NO: 44107 - RNA, 20 nt, Artificial Sequence
  CIITA targeting sequence
uuuaaaaggaggcggggucg

SEQ ID NO: 44108 - RNA, 20 nt, Artificial Sequence
  CIITA targeting sequence
uuuuaaaggagaaacggagu

SEQ ID NO: 44109 - RNA, 20 nt, Artificial Sequence
  CIITA targeting sequence
gggaggggcgacggacgguu

SEQ ID NO: 44110 - RNA, 20 nt, Artificial Sequence
  CIITA targeting sequence
ccgaccccgccuccuuuuaa

SEQ ID NO: 44111 - RNA, 20 nt, Artificial Sequence
  CIITA targeting sequence
ccccuccccgaccccgccuc

SEQ ID NO: 44112 - RNA, 20 nt, Artificial Sequence
  CIITA targeting sequence
gucgccccuccccgaccccg

SEQ ID NO: 44113 - RNA, 20 nt, Artificial Sequence
  CIITA targeting sequence
agggcaaccguccgucgccc

SEQ ID NO: 44114 - RNA, 20 nt, Artificial Sequence
  CIITA targeting sequence
aaaauuuccagggcaaccgu

SEQ ID NO: 44115 - RNA, 20 nt, Artificial Sequence
  CIITA targeting sequence
caaagcgccaauuuucaugg

SEQ ID NO: 44116 - RNA, 20 nt, Artificial Sequence
  CIITA targeting sequence
ugguggagauccaccagugu

SEQ ID NO: 44117 - RNA, 20 nt, Artificial Sequence
  CIITA targeting sequence
accaugaaaauuggcgcuuu

SEQ ID NO: 44118 - RNA, 20 nt, Artificial Sequence
  CIITA targeting sequence
ccaccaugaaaauuggcgcu

SEQ ID NO: 44119 - RNA, 20 nt, Artificial Sequence
  CIITA targeting sequence
accaguguccccuucgcuuc

SEQ ID NO: 44120 - RNA, 20 nt, Artificial Sequence
  CIITA targeting sequence
ccuucgcuucuccaaacucu

SEQ ID NO: 44121 - RNA, 20 nt, Artificial Sequence
  CIITA targeting sequence
cuucuccaaacucugguugc

SEQ ID NO: 44122 - RNA, 20 nt, Artificial Sequence
  CIITA targeting sequence
ccaaacucugguugcuggaa

SEQ ID NO: 44123 - RNA, 20 nt, Artificial Sequence
  CIITA targeting sequence
aaacucugguugcuggaagg

SEQ ID NO: 44124 - RNA, 20 nt, Artificial Sequence
  CIITA targeting sequence
gguugcuggaagguccgccc

SEQ ID NO: 44125 - RNA, 20 nt, Artificial Sequence
  CIITA targeting sequence
agcaaccagaguuuggagaa

SEQ ID NO: 44126 - RNA, 20 nt, Artificial Sequence
  CIITA targeting sequence
gcccacuacggaaccugcau

SEQ ID NO: 44127 - RNA, 20 nt, Artificial Sequence
  CIITA targeting sequence
guagugggcggaccuuccag

SEQ ID NO: 44128 - RNA, 20 nt, Artificial Sequence
  CIITA targeting sequence
uagaguuaaggaacaccuga

SEQ ID NO: 44129 - RNA, 20 nt, Artificial Sequence
  CIITA targeting sequence
aggaugcagguuccguagug

SEQ ID NO: 44130 - RNA, 20 nt, Artificial Sequence
  CIITA targeting sequence
uuaacucuaggaugcagguu

SEQ ID NO: 44131 - RNA, 20 nt, Artificial Sequence
  CIITA targeting sequence
gguguuccuuaacucuagga

SEQ ID NO: 44132 - RNA, 20 nt, Artificial Sequence
  CIITA targeting sequence
uuauucagguguuccuuaac

SEQ ID NO: 44133 - RNA, 20 nt, Artificial Sequence
  CIITA targeting sequence
cuuuauucagguguuccuua

SEQ ID NO: 44134 - RNA, 20 nt, Artificial Sequence
  CIITA targeting sequence
gagguaguucagaucuucaa

SEQ ID NO: 44135 - RNA, 20 nt, Artificial Sequence
  CIITA targeting sequence
gaaucucuuuauucaggugu

SEQ ID NO: 44136 - RNA, 20 nt, Artificial Sequence
  CIITA targeting sequence
gaucuucaaccauaaggaug

SEQ ID NO: 44137 - RNA, 20 nt, Artificial Sequence
  CIITA targeting sequence
gaacuaccucggaaucucuu

SEQ ID NO: 44138 - RNA, 20 nt, Artificial Sequence
  CIITA targeting sequence
ucaaccauaaggaugcuuuu

SEQ ID NO: 44139 - RNA, 20 nt, Artificial Sequence
  CIITA targeting sequence
accauaaggaugcuuuuugu

SEQ ID NO: 44140 - RNA, 20 nt, Artificial Sequence
  CIITA targeting sequence
uuaugguugaagaucugaac

SEQ ID NO: 44141 - RNA, 20 nt, Artificial Sequence
  CIITA targeting sequence
uuuuacuuugugaaucaugu

SEQ ID NO: 44142 - RNA, 20 nt, Artificial Sequence
  CIITA targeting sequence
caaaguaaaaagaaacaaaa

SEQ ID NO: 44143 - RNA, 20 nt, Artificial Sequence
  CIITA targeting sequence
uguuuaaaagcaauaauaca

SEQ ID NO: 44144 - RNA, 20 nt, Artificial Sequence
  CIITA targeting sequence
aacaaccgugaaguacacag

SEQ ID NO: 44145 - RNA, 20 nt, Artificial Sequence
  CIITA targeting sequence
cgguuguuugaauguuuagc

SEQ ID NO: 44146 - RNA, 20 nt, Artificial Sequence
  CIITA targeting sequence
guguacuucacgguuguuug

SEQ ID NO: 44147 - RNA, 20 nt, Artificial Sequence
  CIITA targeting sequence
cuuuucuguguacuucacgg

SEQ ID NO: 44148 - RNA, 20 nt, Artificial Sequence
  CIITA targeting sequence
cucccacccacugguucccc

SEQ ID NO: 44149 - RNA, 20 nt, Artificial Sequence
  CIITA targeting sequence
cccacccacugguuccccug

SEQ ID NO: 44150 - RNA, 20 nt, Artificial Sequence
  CIITA targeting sequence
cacccacugguuccccugcu

SEQ ID NO: 44151 - RNA, 20 nt, Artificial Sequence
  CIITA targeting sequence
ccugcucuuggguaaccguu

SEQ ID NO: 44152 - RNA, 20 nt, Artificial Sequence
  CIITA targeting sequence
uggguaaccguugcaugucu

SEQ ID NO: 44153 - RNA, 20 nt, Artificial Sequence
  CIITA targeting sequence
uucaggaaaacaugaucucg

SEQ ID NO: 44154 - RNA, 20 nt, Artificial Sequence
  CIITA targeting sequence
ggaaaacaugaucucgccca

SEQ ID NO: 44155 - RNA, 20 nt, Artificial Sequence
  CIITA targeting sequence
ugaaagacaugcaacgguua

SEQ ID NO: 44156 - RNA, 20 nt, Artificial Sequence
  CIITA targeting sequence
uguuuuccugaaagacaugc

SEQ ID NO: 44157 - RNA, 20 nt, Artificial Sequence
  CIITA targeting sequence
cgcccaaagagccuuccaaa

SEQ ID NO: 44158 - RNA, 20 nt, Artificial Sequence
  CIITA targeting sequence
cccaaagagccuuccaaagc

SEQ ID NO: 44159 - RNA, 20 nt, Artificial Sequence
  CIITA targeting sequence
uugggcgagaucauguuuuc

SEQ ID NO: 44160 - RNA, 20 nt, Artificial Sequence
  CIITA targeting sequence
aaagcaguucaagaaaccuu

SEQ ID NO: 44161 - RNA, 20 nt, Artificial Sequence
  CIITA targeting sequence
agaaaccuuuaaaucucagg

SEQ ID NO: 44162 - RNA, 20 nt, Artificial Sequence
  CIITA targeting sequence
ugaacugcuuuggaaggcuc

SEQ ID NO: 44163 - RNA, 20 nt, Artificial Sequence
  CIITA targeting sequence
caggccacacugagcugagu

SEQ ID NO: 44164 - RNA, 20 nt, Artificial Sequence
  CIITA targeting sequence
ggccacacugagcugaguau

SEQ ID NO: 44165 - RNA, 20 nt, Artificial Sequence
  CIITA targeting sequence
guguggccugagauuuaaag

SEQ ID NO: 44166 - RNA, 20 nt, Artificial Sequence
  CIITA targeting sequence
gcucaguguggccugagauu

SEQ ID NO: 44167 - RNA, 20 nt, Artificial Sequence
  CIITA targeting sequence
cuuaaucggagguauacaag

SEQ ID NO: 44168 - RNA, 20 nt, Artificial Sequence
  CIITA targeting sequence
gagguauacaaggcagugua

SEQ ID NO: 44169 - RNA, 20 nt, Artificial Sequence
  CIITA targeting sequence
gauuaagcgaugcauguaaa

SEQ ID NO: 44170 - RNA, 20 nt, Artificial Sequence
  CIITA targeting sequence
guaaaaaguacgcacauaca

SEQ ID NO: 44171 - RNA, 20 nt, Artificial Sequence
  CIITA targeting sequence
ucuguaaaaaguacgcacau

SEQ ID NO: 44172 - RNA, 20 nt, Artificial Sequence
  CIITA targeting sequence
uauuuuucaucuguaaaaag

SEQ ID NO: 44173 - RNA, 20 nt, Artificial Sequence
  CIITA targeting sequence
cugggcucguauuuuucauc

SEQ ID NO: 44174 - RNA, 20 nt, Artificial Sequence
  CIITA targeting sequence
uacauuucugagccugggug

SEQ ID NO: 44175 - RNA, 20 nt, Artificial Sequence
  CIITA targeting sequence
gagccuggguguguuucuuu

SEQ ID NO: 44176 - RNA, 20 nt, Artificial Sequence
  CIITA targeting sequence
gaaauguaggaucccugggc

SEQ ID NO: 44177 - RNA, 20 nt, Artificial Sequence
  CIITA targeting sequence
uuggaggccagauccuguuc

SEQ ID NO: 44178 - RNA, 20 nt, Artificial Sequence
  CIITA targeting sequence
aaagaaacacacccaggcuc

SEQ ID NO: 44179 - RNA, 20 nt, Artificial Sequence
  CIITA targeting sequence
ggccuccaaagaaacacacc

SEQ ID NO: 44180 - RNA, 20 nt, Artificial Sequence
  CIITA targeting sequence
uguucuuuuuugcuccauga

SEQ ID NO: 44181 - RNA, 20 nt, Artificial Sequence
  CIITA targeting sequence
uuuuugcuccaugacuuugu

SEQ ID NO: 44182 - RNA, 20 nt, Artificial Sequence
  CIITA targeting sequence
augacuuugucuugccccac

SEQ ID NO: 44183 - RNA, 20 nt, Artificial Sequence
  CIITA targeting sequence
uggagcaaaaaagaacagga

SEQ ID NO: 44184 - RNA, 20 nt, Artificial Sequence
  CIITA targeting sequence
ugccccacucuauaugaauu

SEQ ID NO: 44185 - RNA, 20 nt, Artificial Sequence
  CIITA targeting sequence
auaugaauuacaggacaaac

SEQ ID NO: 44186 - RNA, 20 nt, Artificial Sequence
  CIITA targeting sequence
uauagaguggggcaagacaa

SEQ ID NO: 44187 - RNA, 20 nt, Artificial Sequence
  CIITA targeting sequence
uguaauucauauagaguggg

SEQ ID NO: 44188 - RNA, 20 nt, Artificial Sequence
  CIITA targeting sequence
ccacucuuauccauuucucc

SEQ ID NO: 44189 - RNA, 20 nt, Artificial Sequence
  CIITA targeting sequence
acucuuauccauuucuccaa

SEQ ID NO: 44190 - RNA, 20 nt, Artificial Sequence
  CIITA targeting sequence
uauccauuucuccaacugcu

SEQ ID NO: 44191 - RNA, 20 nt, Artificial Sequence
  CIITA targeting sequence
auuucuccaacugcugaagg

SEQ ID NO: 44192 - RNA, 20 nt, Artificial Sequence
  CIITA targeting sequence
ccaacugcugaaggugaaac

SEQ ID NO: 44193 - RNA, 20 nt, Artificial Sequence
  CIITA targeting sequence
aacugcugaaggugaaacaa

SEQ ID NO: 44194 - RNA, 20 nt, Artificial Sequence
  CIITA targeting sequence
gcaguuggagaaauggauaa

SEQ ID NO: 44195 - RNA, 20 nt, Artificial Sequence
  CIITA targeting sequence
ccuucagcaguuggagaaau

SEQ ID NO: 44196 - RNA, 20 nt, Artificial Sequence
  CIITA targeting sequence
uucaugcacucuaccaauau

SEQ ID NO: 44197 - RNA, 20 nt, Artificial Sequence
  CIITA targeting sequence
ugcacucuaccaauauuugu

SEQ ID NO: 44198 - RNA, 20 nt, Artificial Sequence
  CIITA targeting sequence
accaauauuuguuaaacacc

SEQ ID NO: 44199 - RNA, 20 nt, Artificial Sequence
  CIITA targeting sequence
ccagugccuagcacaagguu

SEQ ID NO: 44200 - RNA, 20 nt, Artificial Sequence
  CIITA targeting sequence
ccccagugccuagcacaagg

SEQ ID NO: 44201 - RNA, 20 nt, Artificial Sequence
  CIITA targeting sequence
ggcccaguucuuucuugagc

SEQ ID NO: 44202 - RNA, 20 nt, Artificial Sequence
  CIITA targeting sequence
uucuugagcagaguuaaugg

SEQ ID NO: 44203 - RNA, 20 nt, Artificial Sequence
  CIITA targeting sequence
ugagcagaguuaaugggaca

SEQ ID NO: 44204 - RNA, 20 nt, Artificial Sequence
  CIITA targeting sequence
agaaagaacugggccagagg

SEQ ID NO: 44205 - RNA, 20 nt, Artificial Sequence
  CIITA targeting sequence
gcucaagaaagaacugggcc

SEQ ID NO: 44206 - RNA, 20 nt, Artificial Sequence
  CIITA targeting sequence
cauuaacucugcucaagaaa

SEQ ID NO: 44207 - RNA, 20 nt, Artificial Sequence
  CIITA targeting sequence
acugugucccauuaacucug

SEQ ID NO: 44208 - RNA, 20 nt, Artificial Sequence
  CIITA targeting sequence
accuuauuaaagguccacug

SEQ ID NO: 44209 - RNA, 20 nt, Artificial Sequence
  CIITA targeting sequence
acauaucaaccuuauuaaag

SEQ ID NO: 44210 - RNA, 20 nt, Artificial Sequence
  CIITA targeting sequence
cuucuacauaucaaccuuau

SEQ ID NO: 44211 - RNA, 20 nt, Artificial Sequence
  CIITA targeting sequence
gucacuucuacauaucaacc

SEQ ID NO: 44212 - RNA, 20 nt, Artificial Sequence
  CIITA targeting sequence
uucagucacuucuacauauc

SEQ ID NO: 44213 - RNA, 20 nt, Artificial Sequence
  CIITA targeting sequence
uucauucagucacuucuaca

SEQ ID NO: 44214 - RNA, 20 nt, Artificial Sequence
  CIITA targeting sequence
auucauucauucagucacuu

SEQ ID NO: 44215 - RNA, 20 nt, Artificial Sequence
  CIITA targeting sequence
aguuuaccauccauucauuc

SEQ ID NO: 44216 - RNA, 20 nt, Artificial Sequence
  CIITA targeting sequence
caaguuuaccauccauucau

SEQ ID NO: 44217 - RNA, 20 nt, Artificial Sequence
  CIITA targeting sequence
ugcccacacugaacuuacca

SEQ ID NO: 44218 - RNA, 20 nt, Artificial Sequence
  CIITA targeting sequence
gugugggcaagacuucucaa

SEQ ID NO: 44219 - RNA, 20 nt, Artificial Sequence
  CIITA targeting sequence
aauccaggguagaaguuaga

SEQ ID NO: 44220 - RNA, 20 nt, Artificial Sequence
  CIITA targeting sequence
aggguagaaguuagauauau

SEQ ID NO: 44221 - RNA, 20 nt, Artificial Sequence
  CIITA targeting sequence
acccuggauuagaaguggua

SEQ ID NO: 44222 - RNA, 20 nt, Artificial Sequence
  CIITA targeting sequence
aacuucuacccuggauuaga

SEQ ID NO: 44223 - RNA, 20 nt, Artificial Sequence
  CIITA targeting sequence
ggcucaugcagaaaguuggg

SEQ ID NO: 44224 - RNA, 20 nt, Artificial Sequence
  CIITA targeting sequence
ugcagaaaguuggguguuuc

SEQ ID NO: 44225 - RNA, 20 nt, Artificial Sequence
  CIITA targeting sequence
gcaugagccagaauauaucu

SEQ ID NO: 44226 - RNA, 20 nt, Artificial Sequence
  CIITA targeting sequence
uuuuucauuuuaacguggua

SEQ ID NO: 44227 - RNA, 20 nt, Artificial Sequence
  CIITA targeting sequence
uuuuaacgugguacuuuggg

SEQ ID NO: 44228 - RNA, 20 nt, Artificial Sequence
  CIITA targeting sequence
caaaguaccacguuaaaaug

SEQ ID NO: 44229 - RNA, 20 nt, Artificial Sequence
  CIITA targeting sequence
augcuauuucccaaaguacc

SEQ ID NO: 44230 - RNA, 20 nt, Artificial Sequence
  CIITA targeting sequence
ggcugaagaccagaggaauc

SEQ ID NO: 44231 - RNA, 20 nt, Artificial Sequence
  CIITA targeting sequence
gccagaauccaugcuauuuc

SEQ ID NO: 44232 - RNA, 20 nt, Artificial Sequence
  CIITA targeting sequence
ucagccagaauccaugcuau

SEQ ID NO: 44233 - RNA, 20 nt, Artificial Sequence
  CIITA targeting sequence
ggucuucagccagaauccau

SEQ ID NO: 44234 - RNA, 20 nt, Artificial Sequence
  CIITA targeting sequence
ucuggucuucagccagaauc

SEQ ID NO: 44235 - RNA, 20 nt, Artificial Sequence
  CIITA targeting sequence
ucuggaaguacaaaauguuc

SEQ ID NO: 44236 - RNA, 20 nt, Artificial Sequence
  CIITA targeting sequence
ggaaguacaaaauguucagu

SEQ ID NO: 44237 - RNA, 20 nt, Artificial Sequence
  CIITA targeting sequence
agaggauuccucuggucuuc

SEQ ID NO: 44238 - RNA, 20 nt, Artificial Sequence
  CIITA targeting sequence
guuuggugcauuguugcauc

SEQ ID NO: 44239 - RNA, 20 nt, Artificial Sequence
  CIITA targeting sequence
agccuuuuccaacacacaca

SEQ ID NO: 44240 - RNA, 20 nt, Artificial Sequence
  CIITA targeting sequence
aacacacacacacacacaca

SEQ ID NO: 44241 - RNA, 20 nt, Artificial Sequence
  CIITA targeting sequence
auuaagugugugugugugug

SEQ ID NO: 44242 - RNA, 20 nt, Artificial Sequence
  CIITA targeting sequence
acuucaauuaagugugugug

SEQ ID NO: 44243 - RNA, 20 nt, Artificial Sequence
  CIITA targeting sequence
uuuuccacuucaauuaagug

SEQ ID NO: 44244 - RNA, 20 nt, Artificial Sequence
  CIITA targeting sequence
ggacaaauaagguuguuauc

SEQ ID NO: 44245 - RNA, 20 nt, Artificial Sequence
  CIITA targeting sequence
ugacagccuuuuucuuuuuc

SEQ ID NO: 44246 - RNA, 20 nt, Artificial Sequence
  CIITA targeting sequence
agugccguuuugguuuauaa

SEQ ID NO: 44247 - RNA, 20 nt, Artificial Sequence
  CIITA targeting sequence
cuuuauaaaccaaaacggca

SEQ ID NO: 44248 - RNA, 20 nt, Artificial Sequence
  CIITA targeting sequence
uucccuuuauaaaccaaaac

SEQ ID NO: 44249 - RNA, 20 nt, Artificial Sequence
  CIITA targeting sequence
uaaccacgcacgcacccuua

SEQ ID NO: 44250 - RNA, 20 nt, Artificial Sequence
  CIITA targeting sequence
ugcaguuaacaaguggcaaa

SEQ ID NO: 44251 - RNA, 20 nt, Artificial Sequence
  CIITA targeting sequence
uggguaagucaaccucucag

SEQ ID NO: 44252 - RNA, 20 nt, Artificial Sequence
  CIITA targeting sequence
accucucagugacuccguuu

SEQ ID NO: 44253 - RNA, 20 nt, Artificial Sequence
  CIITA targeting sequence
cagugacuccguuucccuga

SEQ ID NO: 44254 - RNA, 20 nt, Artificial Sequence
  CIITA targeting sequence
gugacuccguuucccugaug

SEQ ID NO: 44255 - RNA, 20 nt, Artificial Sequence
  CIITA targeting sequence
cugagagguugacuuaccca

SEQ ID NO: 44256 - RNA, 20 nt, Artificial Sequence
  CIITA targeting sequence
guuucccugaugauaaaaua

SEQ ID NO: 44257 - RNA, 20 nt, Artificial Sequence
  CIITA targeting sequence
cugaugauaaaauagguucg

SEQ ID NO: 44258 - RNA, 20 nt, Artificial Sequence
  CIITA targeting sequence
gggaaacggagucacugaga

SEQ ID NO: 44259 - RNA, 20 nt, Artificial Sequence
  CIITA targeting sequence
ucagggaaacggagucacug

SEQ ID NO: 44260 - RNA, 20 nt, Artificial Sequence
  CIITA targeting sequence
auaauaguacccaauucaua

SEQ ID NO: 44261 - RNA, 20 nt, Artificial Sequence
  CIITA targeting sequence
aaccuauuuuaucaucaggg

SEQ ID NO: 44262 - RNA, 20 nt, Artificial Sequence
  CIITA targeting sequence
uaggaugguugugaaaauua

SEQ ID NO: 44263 - RNA, 20 nt, Artificial Sequence
  CIITA targeting sequence
uaugaauuggguacuauuau

SEQ ID NO: 44264 - RNA, 20 nt, Artificial Sequence
  CIITA targeting sequence
caaccauccuaugaauuggg

SEQ ID NO: 44265 - RNA, 20 nt, Artificial Sequence
  CIITA targeting sequence
uaagggcuuuacauauuaag

SEQ ID NO: 44266 - RNA, 20 nt, Artificial Sequence
  CIITA targeting sequence
aauacuauucuuauucuuau

SEQ ID NO: 44267 - RNA, 20 nt, Artificial Sequence
  CIITA targeting sequence
uauucuuauuauaaaucuag

SEQ ID NO: 44268 - RNA, 20 nt, Artificial Sequence
  CIITA targeting sequence
uauuauaaaucuaguaauug

SEQ ID NO: 44269 - RNA, 20 nt, Artificial Sequence
  CIITA targeting sequence
aguaauuguuacuacagugg

SEQ ID NO: 44270 - RNA, 20 nt, Artificial Sequence
  CIITA targeting sequence
ccacuguaguaacaauuacu

SEQ ID NO: 44271 - RNA, 20 nt, Artificial Sequence
  CIITA targeting sequence
uugacccaucuacgccgauu

SEQ ID NO: 44272 - RNA, 20 nt, Artificial Sequence
  CIITA targeting sequence
aggaaagucaccacuguagu

SEQ ID NO: 44273 - RNA, 20 nt, Artificial Sequence
  CIITA targeting sequence
acgccgauucccucuccggg

SEQ ID NO: 44274 - RNA, 20 nt, Artificial Sequence
  CIITA targeting sequence
gcguagaugggucaaggaaa

SEQ ID NO: 44275 - RNA, 20 nt, Artificial Sequence
  CIITA targeting sequence
cucuccgggacugcgcccaa

SEQ ID NO: 44276 - RNA, 20 nt, Artificial Sequence
  CIITA targeting sequence
ccgggacugcgcccaaagcu

SEQ ID NO: 44277 - RNA, 20 nt, Artificial Sequence
  CIITA targeting sequence
gggacugcgcccaaagcuuc

SEQ ID NO: 44278 - RNA, 20 nt, Artificial Sequence
  CIITA targeting sequence
cggagagggaaucggcguag

SEQ ID NO: 44279 - RNA, 20 nt, Artificial Sequence
  CIITA targeting sequence
aauucccgcccacccggagg

SEQ ID NO: 44280 - RNA, 20 nt, Artificial Sequence
  CIITA targeting sequence
cgcccacccggaggauucug

SEQ ID NO: 44281 - RNA, 20 nt, Artificial Sequence
  CIITA targeting sequence
gggugggcgggaauuggaag

SEQ ID NO: 44282 - RNA, 20 nt, Artificial Sequence
  CIITA targeting sequence
uccgggugggcgggaauugg

SEQ ID NO: 44283 - RNA, 20 nt, Artificial Sequence
  CIITA targeting sequence
gcggucgcuccuccucucgc

SEQ ID NO: 44284 - RNA, 20 nt, Artificial Sequence
  CIITA targeting sequence
cuccuccucucgccccgccu

SEQ ID NO: 44285 - RNA, 20 nt, Artificial Sequence
  CIITA targeting sequence
uccucucgccccgccuuuug

SEQ ID NO: 44286 - RNA, 20 nt, Artificial Sequence
  CIITA targeting sequence
ucucgccccgccuuuugugg

SEQ ID NO: 44287 - RNA, 20 nt, Artificial Sequence
  CIITA targeting sequence
cgccccgccuuuuguggaug

SEQ ID NO: 44288 - RNA, 20 nt, Artificial Sequence
  CIITA targeting sequence
ccccgccuuuuguggauggc

SEQ ID NO: 44289 - RNA, 20 nt, Artificial Sequence
  CIITA targeting sequence
acaaaaggcggggcgagagg

SEQ ID NO: 44290 - RNA, 20 nt, Artificial Sequence
  CIITA targeting sequence
ugcaaccgcgggccuacggc

SEQ ID NO: 44291 - RNA, 20 nt, Artificial Sequence
  CIITA targeting sequence
guucgcggaguccugccgcc

SEQ ID NO: 44292 - RNA, 20 nt, Artificial Sequence
  CIITA targeting sequence
cggaguccugccgccgaagg

SEQ ID NO: 44293 - RNA, 20 nt, Artificial Sequence
  CIITA targeting sequence
gcgaacggacuacaaggccc

SEQ ID NO: 44294 - RNA, 20 nt, Artificial Sequence
  CIITA targeting sequence
ugccgccgaaggccacgcgg

SEQ ID NO: 44295 - RNA, 20 nt, Artificial Sequence
  CIITA targeting sequence
gcggcaggacuccgcgaacg

SEQ ID NO: 44296 - RNA, 20 nt, Artificial Sequence
  CIITA targeting sequence
cccgcguggccuucggcggc

SEQ ID NO: 44297 - RNA, 20 nt, Artificial Sequence
  CIITA targeting sequence
cagcgccccacgcggcggcg

SEQ ID NO: 44298 - RNA, 20 nt, Artificial Sequence
  CIITA targeting sequence
aacggccgguuccggcugaa

SEQ ID NO: 44299 - RNA, 20 nt, Artificial Sequence
  CIITA targeting sequence
accgccgcgcuuuacggccg

SEQ ID NO: 44300 - RNA, 20 nt, Artificial Sequence
  CIITA targeting sequence
ggcugaaugucagugcuggg

SEQ ID NO: 44301 - RNA, 20 nt, Artificial Sequence
  CIITA targeting sequence
gccggaaccggccguucgac

SEQ ID NO: 44302 - RNA, 20 nt, Artificial Sequence
  CIITA targeting sequence
gugcugggcugugggccggg

SEQ ID NO: 44303 - RNA, 20 nt, Artificial Sequence
  CIITA targeting sequence
ccggcccacagcccagcacu

SEQ ID NO: 44304 - RNA, 20 nt, Artificial Sequence
  CIITA targeting sequence
uccccggcccacagcccagc

SEQ ID NO: 44305 - RNA, 20 nt, Artificial Sequence
  CIITA targeting sequence
cgguuccuccaccgccuccg

SEQ ID NO: 44306 - RNA, 20 nt, Artificial Sequence
  CIITA targeting sequence
uccaccgccuccgccgccgc

SEQ ID NO: 44307 - RNA, 20 nt, Artificial Sequence
  CIITA targeting sequence
accgccuccgccgccgcauc

SEQ ID NO: 44308 - RNA, 20 nt, Artificial Sequence
  CIITA targeting sequence
gccgccgcauccuccgcuug

SEQ ID NO: 44309 - RNA, 20 nt, Artificial Sequence
  CIITA targeting sequence
uccgcuugugcuaccgccgc

SEQ ID NO: 44310 - RNA, 20 nt, Artificial Sequence
  CIITA targeting sequence
gcuugugcuaccgccgcggg

SEQ ID NO: 44311 - RNA, 20 nt, Artificial Sequence
  CIITA targeting sequence
gcugguccggcaugagaccg

SEQ ID NO: 44312 - RNA, 20 nt, Artificial Sequence
  CIITA targeting sequence
ggcaugagaccgugagacga

SEQ ID NO: 44313 - RNA, 20 nt, Artificial Sequence
  CIITA targeting sequence
ugccggaccagcagagcggc

SEQ ID NO: 44314 - RNA, 20 nt, Artificial Sequence
  CIITA targeting sequence
caugccggaccagcagagcg

SEQ ID NO: 44315 - RNA, 20 nt, Artificial Sequence
  CIITA targeting sequence
cggucucaugccggaccagc

SEQ ID NO: 44316 - RNA, 20 nt, Artificial Sequence
  CIITA targeting sequence
cacggucucaugccggacca

SEQ ID NO: 44317 - RNA, 20 nt, Artificial Sequence
  CIITA targeting sequence
ucucacggucucaugccgga

SEQ ID NO: 44318 - RNA, 20 nt, Artificial Sequence
  CIITA targeting sequence
cgucucacggucucaugccg

SEQ ID NO: 44319 - RNA, 20 nt, Artificial Sequence
  CIITA targeting sequence
cucgucucacggucucaugc

SEQ ID NO: 44320 - RNA, 20 nt, Artificial Sequence
  CIITA targeting sequence
gggccgccgacauguuuggc

SEQ ID NO: 44321 - RNA, 20 nt, Artificial Sequence
  CIITA targeting sequence
gcggccccgacccgucucuc

SEQ ID NO: 44322 - RNA, 20 nt, Artificial Sequence
  CIITA targeting sequence
cggagcugggugggcggggg

SEQ ID NO: 44323 - RNA, 20 nt, Artificial Sequence
  CIITA targeting sequence
gcgagcggccaaacaugucg

SEQ ID NO: 44324 - RNA, 20 nt, Artificial Sequence
  CIITA targeting sequence
ugccauggcccccgcccacc

SEQ ID NO: 44325 - RNA, 20 nt, Artificial Sequence
  CIITA targeting sequence
cgcaacauccacuccuugga

SEQ ID NO: 44326 - RNA, 20 nt, Artificial Sequence
  CIITA targeting sequence
acuccuuggaccaccucaag

SEQ ID NO: 44327 - RNA, 20 nt, Artificial Sequence
  CIITA targeting sequence
uuggaccaccucaagugagu

SEQ ID NO: 44328 - RNA, 20 nt, Artificial Sequence
  CIITA targeting sequence
aaggaguggauguugcggga

SEQ ID NO: 44329 - RNA, 20 nt, Artificial Sequence
  CIITA targeting sequence
agugaguguggggggcguag

SEQ ID NO: 44330 - RNA, 20 nt, Artificial Sequence
  CIITA targeting sequence
cuugaggugguccaaggagu

SEQ ID NO: 44331 - RNA, 20 nt, Artificial Sequence
  CIITA targeting sequence
cgcuacgccccccacacuca

SEQ ID NO: 44332 - RNA, 20 nt, Artificial Sequence
  CIITA targeting sequence
gggcuggacagggggacggg

SEQ ID NO: 44333 - RNA, 20 nt, Artificial Sequence
  CIITA targeting sequence
agccccgaggccucccgcua

SEQ ID NO: 44334 - RNA, 20 nt, Artificial Sequence
  CIITA targeting sequence
cccuguccagccccgaggcc

SEQ ID NO: 44335 - RNA, 20 nt, Artificial Sequence
  CIITA targeting sequence
gcgccccgucccccugucca

SEQ ID NO: 44336 - RNA, 20 nt, Artificial Sequence
  CIITA targeting sequence
gggucggggcucuaggaggc

SEQ ID NO: 44337 - RNA, 20 nt, Artificial Sequence
  CIITA targeting sequence
gggcucuaggaggcgugaga

SEQ ID NO: 44338 - RNA, 20 nt, Artificial Sequence
  CIITA targeting sequence
aggaggcgugagagcggcgg

SEQ ID NO: 44339 - RNA, 20 nt, Artificial Sequence
  CIITA targeting sequence
uagagccccgacccggagcu

SEQ ID NO: 44340 - RNA, 20 nt, Artificial Sequence
  CIITA targeting sequence
cgccuccuagagccccgacc

SEQ ID NO: 44341 - RNA, 20 nt, Artificial Sequence
  CIITA targeting sequence
cacgccuccuagagccccga

SEQ ID NO: 44342 - RNA, 20 nt, Artificial Sequence
  CIITA targeting sequence
ccgccgcucucacgccuccu

SEQ ID NO: 44343 - RNA, 20 nt, Artificial Sequence
  CIITA targeting sequence
ccgggcgcccuucgccgccg

SEQ ID NO: 44344 - RNA, 20 nt, Artificial Sequence
  CIITA targeting sequence
uaaccaccacacgggcuucc

SEQ ID NO: 44345 - RNA, 20 nt, Artificial Sequence
  CIITA targeting sequence
cucuuaaccaccacacgggc

SEQ ID NO: 44346 - RNA, 20 nt, Artificial Sequence
  CIITA targeting sequence
ggagucagggcgccuggguu

SEQ ID NO: 44347 - RNA, 20 nt, Artificial Sequence
  CIITA targeting sequence
cgagcccucgcucuuaacca

SEQ ID NO: 44348 - RNA, 20 nt, Artificial Sequence
  CIITA targeting sequence
gggcgccuggguucgaaccc

SEQ ID NO: 44349 - RNA, 20 nt, Artificial Sequence
  CIITA targeting sequence
aacccugaccccgucgcucu

SEQ ID NO: 44350 - RNA, 20 nt, Artificial Sequence
  CIITA targeting sequence
aacccaggcgcccugacucc

SEQ ID NO: 44351 - RNA, 20 nt, Artificial Sequence
  CIITA targeting sequence
ggguucgaacccaggcgccc

SEQ ID NO: 44352 - RNA, 20 nt, Artificial Sequence
  CIITA targeting sequence
cucuuggcugugugaccuug

SEQ ID NO: 44353 - RNA, 20 nt, Artificial Sequence
  CIITA targeting sequence
uggcugugugaccuuggaca

SEQ ID NO: 44354 - RNA, 20 nt, Artificial Sequence
  CIITA targeting sequence
cacagccaagagcgacgggg

SEQ ID NO: 44355 - RNA, 20 nt, Artificial Sequence
  CIITA targeting sequence
aaggucacacagccaagagc

SEQ ID NO: 44356 - RNA, 20 nt, Artificial Sequence
  CIITA targeting sequence
cuuaauuucucagagucucc

SEQ ID NO: 44357 - RNA, 20 nt, Artificial Sequence
  CIITA targeting sequence
cagagucuccguauccccac

SEQ ID NO: 44358 - RNA, 20 nt, Artificial Sequence
  CIITA targeting sequence
gagucuccguauccccaccu

SEQ ID NO: 44359 - RNA, 20 nt, Artificial Sequence
  CIITA targeting sequence
gagaaauuaagcgacuuguc

SEQ ID NO: 44360 - RNA, 20 nt, Artificial Sequence
  CIITA targeting sequence
ccguauccccaccuguaaag

SEQ ID NO: 44361 - RNA, 20 nt, Artificial Sequence
  CIITA targeting sequence
guauccccaccuguaaagcg

SEQ ID NO: 44362 - RNA, 20 nt, Artificial Sequence
  CIITA targeting sequence
ccaccuguaaagcgagagga

SEQ ID NO: 44363 - RNA, 20 nt, Artificial Sequence
  CIITA targeting sequence
cuuuacagguggggauacgg

SEQ ID NO: 44364 - RNA, 20 nt, Artificial Sequence
  CIITA targeting sequence
cgcuuuacagguggggauac

SEQ ID NO: 44365 - RNA, 20 nt, Artificial Sequence
  CIITA targeting sequence
ucucgcuuuacaggugggga

SEQ ID NO: 44366 - RNA, 20 nt, Artificial Sequence
  CIITA targeting sequence
cauccucucgcuuuacaggu

SEQ ID NO: 44367 - RNA, 20 nt, Artificial Sequence
  CIITA targeting sequence
guuuauggacacagacuuug

SEQ ID NO: 44368 - RNA, 20 nt, Artificial Sequence
  CIITA targeting sequence
auaaacugaaaucgcauccu

SEQ ID NO: 44369 - RNA, 20 nt, Artificial Sequence
  CIITA targeting sequence
guguccauaaacugaaaucg

SEQ ID NO: 44370 - RNA, 20 nt, Artificial Sequence
  CIITA targeting sequence
ugacgguguccaccaaguuu

SEQ ID NO: 44371 - RNA, 20 nt, Artificial Sequence
  CIITA targeting sequence
agaacaaagucuguguccau

SEQ ID NO: 44372 - RNA, 20 nt, Artificial Sequence
  CIITA targeting sequence
accaaguuuccuggcggggu

SEQ ID NO: 44373 - RNA, 20 nt, Artificial Sequence
  CIITA targeting sequence
uggcgggguacuucuuaaac

SEQ ID NO: 44374 - RNA, 20 nt, Artificial Sequence
  CIITA targeting sequence
uaaacugaacagcuuagagg

SEQ ID NO: 44375 - RNA, 20 nt, Artificial Sequence
  CIITA targeting sequence
guuuaagaaguaccccgcca

SEQ ID NO: 44376 - RNA, 20 nt, Artificial Sequence
  CIITA targeting sequence
aagcuguucaguuuaagaag

SEQ ID NO: 44377 - RNA, 20 nt, Artificial Sequence
  CIITA targeting sequence
aaggccuggguccuggaguc

SEQ ID NO: 44378 - RNA, 20 nt, Artificial Sequence
  CIITA targeting sequence
uggagucgggcagaucuggg

SEQ ID NO: 44379 - RNA, 20 nt, Artificial Sequence
  CIITA targeting sequence
aggacccaggccuuugaccc

SEQ ID NO: 44380 - RNA, 20 nt, Artificial Sequence
  CIITA targeting sequence
ggcagaucuggguccgaauc

SEQ ID NO: 44381 - RNA, 20 nt, Artificial Sequence
  CIITA targeting sequence
gcccgacuccaggacccagg

SEQ ID NO: 44382 - RNA, 20 nt, Artificial Sequence
  CIITA targeting sequence
ggguccgaaucuaucugugu

SEQ ID NO: 44383 - RNA, 20 nt, Artificial Sequence
  CIITA targeting sequence
gaaucuaucugugugaaugu

SEQ ID NO: 44384 - RNA, 20 nt, Artificial Sequence
  CIITA targeting sequence
gacccagaucugcccgacuc

SEQ ID NO: 44385 - RNA, 20 nt, Artificial Sequence
  CIITA targeting sequence
aucugugugaauguaggccu

SEQ ID NO: 44386 - RNA, 20 nt, Artificial Sequence
  CIITA targeting sequence
gugugaauguaggccucagg

SEQ ID NO: 44387 - RNA, 20 nt, Artificial Sequence
  CIITA targeting sequence
cacagauagauucggaccca

SEQ ID NO: 44388 - RNA, 20 nt, Artificial Sequence
  CIITA targeting sequence
gguuccccacuuguaaaaag

SEQ ID NO: 44389 - RNA, 20 nt, Artificial Sequence
  CIITA targeting sequence
ccacuuguaaaaagaguaga

SEQ ID NO: 44390 - RNA, 20 nt, Artificial Sequence
  CIITA targeting sequence
uuuuacaaguggggaaccug

SEQ ID NO: 44391 - RNA, 20 nt, Artificial Sequence
  CIITA targeting sequence
acucuuuuuacaagugggga

SEQ ID NO: 44392 - RNA, 20 nt, Artificial Sequence
  CIITA targeting sequence
cucuacucuuuuuacaagug

SEQ ID NO: 44393 - RNA, 20 nt, Artificial Sequence
  CIITA targeting sequence
ugcuauuguguugagaguug

SEQ ID NO: 44394 - RNA, 20 nt, Artificial Sequence
  CIITA targeting sequence
acacaauagcaggaagcagg

SEQ ID NO: 44395 - RNA, 20 nt, Artificial Sequence
  CIITA targeting sequence
caacacaauagcaggaagca

SEQ ID NO: 44396 - RNA, 20 nt, Artificial Sequence
  CIITA targeting sequence
aaccaacucucaacacaaua

SEQ ID NO: 44397 - RNA, 20 nt, Artificial Sequence
  CIITA targeting sequence
uauccaaccaacucucaaca

SEQ ID NO: 44398 - RNA, 20 nt, Artificial Sequence
  CIITA targeting sequence
cuuauccaaccaacucucaa

SEQ ID NO: 44399 - RNA, 20 nt, Artificial Sequence
  CIITA targeting sequence
uucucuuauccaaccaacuc

SEQ ID NO: 44400 - RNA, 20 nt, Artificial Sequence
  CIITA targeting sequence
gaacacguacaauugcucau

SEQ ID NO: 44401 - RNA, 20 nt, Artificial Sequence
  CIITA targeting sequence
gagcuuaacguucauucucu

SEQ ID NO: 44402 - RNA, 20 nt, Artificial Sequence
  CIITA targeting sequence
uuaaacggcauuaauuauua

SEQ ID NO: 44403 - RNA, 20 nt, Artificial Sequence
  CIITA targeting sequence
uuuauaauaauuaaugccgu

SEQ ID NO: 44404 - RNA, 20 nt, Artificial Sequence
  CIITA targeting sequence
guucuuuuauaauaauuaau

SEQ ID NO: 44405 - RNA, 20 nt, Artificial Sequence
  CIITA targeting sequence
gaggggagucuaagcugggg

SEQ ID NO: 44406 - RNA, 20 nt, Artificial Sequence
  CIITA targeting sequence
gaaaauaaucuguucuuuua

SEQ ID NO: 44407 - RNA, 20 nt, Artificial Sequence
  CIITA targeting sequence
ccucggaaaauaaucuguuc

SEQ ID NO: 44408 - RNA, 20 nt, Artificial Sequence
  CIITA targeting sequence
aagcugggggcaugcacgcu

SEQ ID NO: 44409 - RNA, 20 nt, Artificial Sequence
  CIITA targeting sequence
gcgugcaugcccccagcuua

SEQ ID NO: 44410 - RNA, 20 nt, Artificial Sequence
  CIITA targeting sequence
cagcgugcaugcccccagcu

SEQ ID NO: 44411 - RNA, 20 nt, Artificial Sequence
  CIITA targeting sequence
ugggucucagcgugcaugcc

SEQ ID NO: 44412 - RNA, 20 nt, Artificial Sequence
  CIITA targeting sequence
ccccaaaauccugggucuca

SEQ ID NO: 44413 - RNA, 20 nt, Artificial Sequence
  CIITA targeting sequence
ccaaucgccccaaaauccug

SEQ ID NO: 44414 - RNA, 20 nt, Artificial Sequence
  CIITA targeting sequence
uccccaaucgccccaaaauc

SEQ ID NO: 44415 - RNA, 20 nt, Artificial Sequence
  CIITA targeting sequence
uccuccccaaucgccccaaa

SEQ ID NO: 44416 - RNA, 20 nt, Artificial Sequence
  CIITA targeting sequence
ucauccuccccaaucgcccc

SEQ ID NO: 44417 - RNA, 20 nt, Artificial Sequence
  CIITA targeting sequence
auuuuucaucauccucccca

SEQ ID NO: 44418 - RNA, 20 nt, Artificial Sequence
  CIITA targeting sequence
cuauuuuucaucauccuccc

SEQ ID NO: 44419 - RNA, 20 nt, Artificial Sequence
  CIITA targeting sequence
gaggagggaaugacucuaca

SEQ ID NO: 44420 - RNA, 20 nt, Artificial Sequence
  CIITA targeting sequence
gaggucucuauuuuucauca

SEQ ID NO: 44421 - RNA, 20 nt, Artificial Sequence
  CIITA targeting sequence
ucagaggucucuauuuuuca

SEQ ID NO: 44422 - RNA, 20 nt, Artificial Sequence
  CIITA targeting sequence
cuccucagaggucucuauuu

SEQ ID NO: 44423 - RNA, 20 nt, Artificial Sequence
  CIITA targeting sequence
uucccuccucagaggucucu

SEQ ID NO: 44424 - RNA, 20 nt, Artificial Sequence
  CIITA targeting sequence
acagcucugggggaggacag

SEQ ID NO: 44425 - RNA, 20 nt, Artificial Sequence
  CIITA targeting sequence
gggggaggacagguggcaga

SEQ ID NO: 44426 - RNA, 20 nt, Artificial Sequence
  CIITA targeting sequence
cccagagcuguagagucauu

SEQ ID NO: 44427 - RNA, 20 nt, Artificial Sequence
  CIITA targeting sequence
ucccccagagcuguagaguc

SEQ ID NO: 44428 - RNA, 20 nt, Artificial Sequence
  CIITA targeting sequence
gccaccuguccucccccaga

SEQ ID NO: 44429 - RNA, 20 nt, Artificial Sequence
  CIITA targeting sequence
ugggaccaggagugcagaaa

SEQ ID NO: 44430 - RNA, 20 nt, Artificial Sequence
  CIITA targeting sequence
caagacccuaucugccaccu

SEQ ID NO: 44431 - RNA, 20 nt, Artificial Sequence
  CIITA targeting sequence
uggucccaagacccuaucug

SEQ ID NO: 44432 - RNA, 20 nt, Artificial Sequence
  CIITA targeting sequence
gcacuccuggucccaagacc

SEQ ID NO: 44433 - RNA, 20 nt, Artificial Sequence
  CIITA targeting sequence
uaauuucugcacuccugguc

SEQ ID NO: 44434 - RNA, 20 nt, Artificial Sequence
  CIITA targeting sequence
aauccugaaaccaccauuua

SEQ ID NO: 44435 - RNA, 20 nt, Artificial Sequence
  CIITA targeting sequence
ugaaaccaccauuuacuggc

SEQ ID NO: 44436 - RNA, 20 nt, Artificial Sequence
  CIITA targeting sequence
ggauuugaacgcaggugugg

SEQ ID NO: 44437 - RNA, 20 nt, Artificial Sequence
  CIITA targeting sequence
cacagccaguaaaugguggu

SEQ ID NO: 44438 - RNA, 20 nt, Artificial Sequence
  CIITA targeting sequence
ccucucugagccuccagauu

SEQ ID NO: 44439 - RNA, 20 nt, Artificial Sequence
  CIITA targeting sequence
cugagccuccagauucccau

SEQ ID NO: 44440 - RNA, 20 nt, Artificial Sequence
  CIITA targeting sequence
gagccuccagauucccauuu

SEQ ID NO: 44441 - RNA, 20 nt, Artificial Sequence
  CIITA targeting sequence
gagaggugaaguaauuugcc

SEQ ID NO: 44442 - RNA, 20 nt, Artificial Sequence
  CIITA targeting sequence
agauucccauuugcaaaugg

SEQ ID NO: 44443 - RNA, 20 nt, Artificial Sequence
  CIITA targeting sequence
ggaggcucagagaggugaag

SEQ ID NO: 44444 - RNA, 20 nt, Artificial Sequence
  CIITA targeting sequence
cauuugcaaauggggaucgu

SEQ ID NO: 44445 - RNA, 20 nt, Artificial Sequence
  CIITA targeting sequence
ccauuugcaaaugggaaucu

SEQ ID NO: 44446 - RNA, 20 nt, Artificial Sequence
  CIITA targeting sequence
ugaacauuguaauggaaaug

SEQ ID NO: 44447 - RNA, 20 nt, Artificial Sequence
  CIITA targeting sequence
cgauccccauuugcaaaugg

SEQ ID NO: 44448 - RNA, 20 nt, Artificial Sequence
  CIITA targeting sequence
auuacaauguucacgauccc

SEQ ID NO: 44449 - RNA, 20 nt, Artificial Sequence
  CIITA targeting sequence
auuuccauuacaauguucac

SEQ ID NO: 44450 - RNA, 20 nt, Artificial Sequence
  CIITA targeting sequence
ccuuccauuuccauuacaau

SEQ ID NO: 44451 - RNA, 20 nt, Artificial Sequence
  CIITA targeting sequence
gucaccuuccauuuccauua

SEQ ID NO: 44452 - RNA, 20 nt, Artificial Sequence
  CIITA targeting sequence
gcucagcgaggccuucccag

SEQ ID NO: 44453 - RNA, 20 nt, Artificial Sequence
  CIITA targeting sequence
gcgaggccuucccagaccac

SEQ ID NO: 44454 - RNA, 20 nt, Artificial Sequence
  CIITA targeting sequence
cugagcugauaauaaacaca

SEQ ID NO: 44455 - RNA, 20 nt, Artificial Sequence
  CIITA targeting sequence
cagaccacccuaccuaacgu

SEQ ID NO: 44456 - RNA, 20 nt, Artificial Sequence
  CIITA targeting sequence
gggaaggccucgcugagcug

SEQ ID NO: 44457 - RNA, 20 nt, Artificial Sequence
  CIITA targeting sequence
ccccaucccaguuccuaucc

SEQ ID NO: 44458 - RNA, 20 nt, Artificial Sequence
  CIITA targeting sequence
caguuccuauccaucacauc

SEQ ID NO: 44459 - RNA, 20 nt, Artificial Sequence
  CIITA targeting sequence
uauccaucacaucuuucucu

SEQ ID NO: 44460 - RNA, 20 nt, Artificial Sequence
  CIITA targeting sequence
aucacaucuuucucuugcuu

SEQ ID NO: 44461 - RNA, 20 nt, Artificial Sequence
  CIITA targeting sequence
caucuuucucuugcuuucau

SEQ ID NO: 44462 - RNA, 20 nt, Artificial Sequence
  CIITA targeting sequence
uucucuugcuuucauugagu

SEQ ID NO: 44463 - RNA, 20 nt, Artificial Sequence
  CIITA targeting sequence
cuugcuuucauugagugcuu

SEQ ID NO: 44464 - RNA, 20 nt, Artificial Sequence
  CIITA targeting sequence
ugcuuucauugagugcuucu

SEQ ID NO: 44465 - RNA, 20 nt, Artificial Sequence
  CIITA targeting sequence
uugagugcuucuccacucuc

SEQ ID NO: 44466 - RNA, 20 nt, Artificial Sequence
  CIITA targeting sequence
augaaagcaagagaaagaug

SEQ ID NO: 44467 - RNA, 20 nt, Artificial Sequence
  CIITA targeting sequence
ccacucucugcgauuauucu

SEQ ID NO: 44468 - RNA, 20 nt, Artificial Sequence
  CIITA targeting sequence
acucucugcgauuauucuuu

SEQ ID NO: 44469 - RNA, 20 nt, Artificial Sequence
  CIITA targeting sequence
cugcgauuauucuuuauuuu

SEQ ID NO: 44470 - RNA, 20 nt, Artificial Sequence
  CIITA targeting sequence
gcgauuauucuuuauuuuuu

SEQ ID NO: 44471 - RNA, 20 nt, Artificial Sequence
  CIITA targeting sequence
cagagaguggagaagcacuc

SEQ ID NO: 44472 - RNA, 20 nt, Artificial Sequence
  CIITA targeting sequence
uuauuuuuuauuuauacuua

SEQ ID NO: 44473 - RNA, 20 nt, Artificial Sequence
  CIITA targeting sequence
gucuucuguuaaacuggcac

SEQ ID NO: 44474 - RNA, 20 nt, Artificial Sequence
  CIITA targeting sequence
ucuguuaaacuggcacuuca

SEQ ID NO: 44475 - RNA, 20 nt, Artificial Sequence
  CIITA targeting sequence
guuaaacuggcacuucacga

SEQ ID NO: 44476 - RNA, 20 nt, Artificial Sequence
  CIITA targeting sequence
cgagggcacagacugcuugg

SEQ ID NO: 44477 - RNA, 20 nt, Artificial Sequence
  CIITA targeting sequence
ugaagugccaguuuaacaga

SEQ ID NO: 44478 - RNA, 20 nt, Artificial Sequence
  CIITA targeting sequence
gugcccucgugaagugccag

SEQ ID NO: 44479 - RNA, 20 nt, Artificial Sequence
  CIITA targeting sequence
caguuguauucccagcaucu

SEQ ID NO: 44480 - RNA, 20 nt, Artificial Sequence
  CIITA targeting sequence
cagcaucuaggacugcucuc

SEQ ID NO: 44481 - RNA, 20 nt, Artificial Sequence
  CIITA targeting sequence
aggacugcucucugcuuacu

SEQ ID NO: 44482 - RNA, 20 nt, Artificial Sequence
  CIITA targeting sequence
uagaugcugggaauacaacu

SEQ ID NO: 44483 - RNA, 20 nt, Artificial Sequence
  CIITA targeting sequence
cugcuuacuuaaagagugga

SEQ ID NO: 44484 - RNA, 20 nt, Artificial Sequence
  CIITA targeting sequence
gcuuacuuaaagaguggaaa

SEQ ID NO: 44485 - RNA, 20 nt, Artificial Sequence
  CIITA targeting sequence
uuaaguaagcagagagcagu

SEQ ID NO: 44486 - RNA, 20 nt, Artificial Sequence
  CIITA targeting sequence
acucuuuaaguaagcagaga

SEQ ID NO: 44487 - RNA, 20 nt, Artificial Sequence
  CIITA targeting sequence
uuuuuccacucuuuaaguaa

SEQ ID NO: 44488 - RNA, 20 nt, Artificial Sequence
  CIITA targeting sequence
uucauuuuuccacucuuuaa

SEQ ID NO: 44489 - RNA, 20 nt, Artificial Sequence
  CIITA targeting sequence
aucauucauuuuuccacucu

SEQ ID NO: 44490 - RNA, 20 nt, Artificial Sequence
  CIITA targeting sequence
ccaauucaaucauucauuuu

SEQ ID NO: 44491 - RNA, 20 nt, Artificial Sequence
  CIITA targeting sequence
ccccaauucaaucauucauu

SEQ ID NO: 44492 - RNA, 20 nt, Artificial Sequence
  CIITA targeting sequence
cuccccaauucaaucauuca

SEQ ID NO: 44493 - RNA, 20 nt, Artificial Sequence
  CIITA targeting sequence
ucucuccccaauucaaucau

SEQ ID NO: 44494 - RNA, 20 nt, Artificial Sequence
  CIITA targeting sequence
ucaucucuccccaauucaau

SEQ ID NO: 44495 - RNA, 20 nt, Artificial Sequence
  CIITA targeting sequence
uggccugcaugcucuucauc

SEQ ID NO: 44496 - RNA, 20 nt, Artificial Sequence
  CIITA targeting sequence
uggguccuggccugcaugcu

SEQ ID NO: 44497 - RNA, 20 nt, Artificial Sequence
  CIITA targeting sequence
acaccugcccccaaauccug

SEQ ID NO: 44498 - RNA, 20 nt, Artificial Sequence
  CIITA targeting sequence
uccacaccugcccccaaauc

SEQ ID NO: 44499 - RNA, 20 nt, Artificial Sequence
  CIITA targeting sequence
uccuccacaccugcccccaa

SEQ ID NO: 44500 - RNA, 20 nt, Artificial Sequence
  CIITA targeting sequence
ucauccuccacaccugcccc

SEQ ID NO: 44501 - RNA, 20 nt, Artificial Sequence
  CIITA targeting sequence
auuuuucaucauccuccaca

SEQ ID NO: 44502 - RNA, 20 nt, Artificial Sequence
  CIITA targeting sequence
cuauuuuucaucauccucca

SEQ ID NO: 44503 - RNA, 20 nt, Artificial Sequence
  CIITA targeting sequence
guaugaagggaaaggcuuua

SEQ ID NO: 44504 - RNA, 20 nt, Artificial Sequence
  CIITA targeting sequence
uacagaucucuauuuuucau

SEQ ID NO: 44505 - RNA, 20 nt, Artificial Sequence
  CIITA targeting sequence
cuucauacagaucucuauuu

SEQ ID NO: 44506 - RNA, 20 nt, Artificial Sequence
  CIITA targeting sequence
cuaaagccuuucccuucaua

SEQ ID NO: 44507 - RNA, 20 nt, Artificial Sequence
  CIITA targeting sequence
cucccuaaagccuuucccuu

SEQ ID NO: 44508 - RNA, 20 nt, Artificial Sequence
  CIITA targeting sequence
ccgccauuucccucccuaaa

SEQ ID NO: 44509 - RNA, 20 nt, Artificial Sequence
  CIITA targeting sequence
gcauccccgccauuucccuc

SEQ ID NO: 44510 - RNA, 20 nt, Artificial Sequence
  CIITA targeting sequence
ucagcauccccgccauuucc

SEQ ID NO: 44511 - RNA, 20 nt, Artificial Sequence
  CIITA targeting sequence
ccucuucagcauccccgcca

SEQ ID NO: 44512 - RNA, 20 nt, Artificial Sequence
  CIITA targeting sequence
acuccccucuucagcauccc

SEQ ID NO: 44513 - RNA, 20 nt, Artificial Sequence
  CIITA targeting sequence
ucagugucaagaaauaggca

SEQ ID NO: 44514 - RNA, 20 nt, Artificial Sequence
  CIITA targeting sequence
gugucaagaaauaggcaggu

SEQ ID NO: 44515 - RNA, 20 nt, Artificial Sequence
  CIITA targeting sequence
agaaauaggcagguuuccag

SEQ ID NO: 44516 - RNA, 20 nt, Artificial Sequence
  CIITA targeting sequence
ugacacugaagauuugucua

SEQ ID NO: 44517 - RNA, 20 nt, Artificial Sequence
  CIITA targeting sequence
agaaggagauccugagacua

SEQ ID NO: 44518 - RNA, 20 nt, Artificial Sequence
  CIITA targeting sequence
ggaaaccugccuauuucuug

SEQ ID NO: 44519 - RNA, 20 nt, Artificial Sequence
  CIITA targeting sequence
uucuggaaaccugccuauuu

SEQ ID NO: 44520 - RNA, 20 nt, Artificial Sequence
  CIITA targeting sequence
ccuucuggaaaccugccuau

SEQ ID NO: 44521 - RNA, 20 nt, Artificial Sequence
  CIITA targeting sequence
ugagacuacuaaugggaaag

SEQ ID NO: 44522 - RNA, 20 nt, Artificial Sequence
  CIITA targeting sequence
ggaucuccuucuggaaaccu

SEQ ID NO: 44523 - RNA, 20 nt, Artificial Sequence
  CIITA targeting sequence
caggaucuccuucuggaaac

SEQ ID NO: 44524 - RNA, 20 nt, Artificial Sequence
  CIITA targeting sequence
cauuaguagucucaggaucu

SEQ ID NO: 44525 - RNA, 20 nt, Artificial Sequence
  CIITA targeting sequence
uuucccauuaguagucucag

SEQ ID NO: 44526 - RNA, 20 nt, Artificial Sequence
  CIITA targeting sequence
uccuuucccauuaguagucu

SEQ ID NO: 44527 - RNA, 20 nt, Artificial Sequence
  CIITA targeting sequence
uccuccuuucccauuaguag

SEQ ID NO: 44528 - RNA, 20 nt, Artificial Sequence
  CIITA targeting sequence
cuaacccuaucuuccuccuu

SEQ ID NO: 44529 - RNA, 20 nt, Artificial Sequence
  CIITA targeting sequence
caccauaucccuaacccuau

SEQ ID NO: 44530 - RNA, 20 nt, Artificial Sequence
  CIITA targeting sequence
acuacuucccaccauauccc

SEQ ID NO: 44531 - RNA, 20 nt, Artificial Sequence
  CIITA targeting sequence
cuuccacuacuucccaccau

SEQ ID NO: 44532 - RNA, 20 nt, Artificial Sequence
  CIITA targeting sequence
cccuuccacuacuucccacc

SEQ ID NO: 44533 - RNA, 20 nt, Artificial Sequence
  CIITA targeting sequence
acagccccgucucccuucca

SEQ ID NO: 44534 - RNA, 20 nt, Artificial Sequence
  CIITA targeting sequence
uuuccacagccccgucuccc

SEQ ID NO: 44535 - RNA, 20 nt, Artificial Sequence
  CIITA targeting sequence
caccaauccuuuccacagcc

SEQ ID NO: 44536 - RNA, 20 nt, Artificial Sequence
  CIITA targeting sequence
cucccaccaauccuuuccac

SEQ ID NO: 44537 - RNA, 20 nt, Artificial Sequence
  CIITA targeting sequence
aauucccucccaccaauccu

SEQ ID NO: 44538 - RNA, 20 nt, Artificial Sequence
  CIITA targeting sequence
cuaucuaauucccucccacc

SEQ ID NO: 44539 - RNA, 20 nt, Artificial Sequence
  CIITA targeting sequence
cauguguccccgggaguggg

SEQ ID NO: 44540 - RNA, 20 nt, Artificial Sequence
  CIITA targeting sequence
uguguccccgggaguggggu

SEQ ID NO: 44541 - RNA, 20 nt, Artificial Sequence
  CIITA targeting sequence
ccgggagugggguaggggua

SEQ ID NO: 44542 - RNA, 20 nt, Artificial Sequence
  CIITA targeting sequence
cggggacacaugagaagucc

SEQ ID NO: 44543 - RNA, 20 nt, Artificial Sequence
  CIITA targeting sequence
cagcugugaccuuucuagca

SEQ ID NO: 44544 - RNA, 20 nt, Artificial Sequence
  CIITA targeting sequence
gcugugaccuuucuagcaug

SEQ ID NO: 44545 - RNA, 20 nt, Artificial Sequence
  CIITA targeting sequence
cagcugagaacuguggcccu

SEQ ID NO: 44546 - RNA, 20 nt, Artificial Sequence
  CIITA targeting sequence
agcauggagcagcauuuagu

SEQ ID NO: 44547 - RNA, 20 nt, Artificial Sequence
  CIITA targeting sequence
augcuagaaaggucacagcu

SEQ ID NO: 44548 - RNA, 20 nt, Artificial Sequence
  CIITA targeting sequence
caaacguuuacuaaaugcug

SEQ ID NO: 44549 - RNA, 20 nt, Artificial Sequence
  CIITA targeting sequence
ugaagaguggggagcaggag

SEQ ID NO: 44550 - RNA, 20 nt, Artificial Sequence
  CIITA targeting sequence
agacucacaaacguuuacua

SEQ ID NO: 44551 - RNA, 20 nt, Artificial Sequence
  CIITA targeting sequence
ucaagacucacaaacguuua

SEQ ID NO: 44552 - RNA, 20 nt, Artificial Sequence
  CIITA targeting sequence
ccacucuucaagacucacaa

SEQ ID NO: 44553 - RNA, 20 nt, Artificial Sequence
  CIITA targeting sequence
ugcuccccacucuucaagac

SEQ ID NO: 44554 - RNA, 20 nt, Artificial Sequence
  CIITA targeting sequence
cuauguggugaggggcacuu

SEQ ID NO: 44555 - RNA, 20 nt, Artificial Sequence
  CIITA targeting sequence
ccacauagugaacccuccug

SEQ ID NO: 44556 - RNA, 20 nt, Artificial Sequence
  CIITA targeting sequence
aaaagugccccucaccacau

SEQ ID NO: 44557 - RNA, 20 nt, Artificial Sequence
  CIITA targeting sequence
ugcucuaaaagugccccuca

SEQ ID NO: 44558 - RNA, 20 nt, Artificial Sequence
  CIITA targeting sequence
ccaccuccugcucuaaaagu

SEQ ID NO: 44559 - RNA, 20 nt, Artificial Sequence
  CIITA targeting sequence
caccaccuccugcucuaaaa

SEQ ID NO: 44560 - RNA, 20 nt, Artificial Sequence
  CIITA targeting sequence
cucaccaccuccugcucuaa

SEQ ID NO: 44561 - RNA, 20 nt, Artificial Sequence
  CIITA targeting sequence
ucucucaccaccuccugcuc

SEQ ID NO: 44562 - RNA, 20 nt, Artificial Sequence
  CIITA targeting sequence
ccuugucuucucucaccacc

SEQ ID NO: 44563 - RNA, 20 nt, Artificial Sequence
  CIITA targeting sequence
uccccuugucuucucucacc

SEQ ID NO: 44564 - RNA, 20 nt, Artificial Sequence
  CIITA targeting sequence
uuccuccccuugucuucucu

SEQ ID NO: 44565 - RNA, 20 nt, Artificial Sequence
  CIITA targeting sequence
ugggccucuuuccuccccuu

SEQ ID NO: 44566 - RNA, 20 nt, Artificial Sequence
  CIITA targeting sequence
gggguggguagggagguggg

SEQ ID NO: 44567 - RNA, 20 nt, Artificial Sequence
  CIITA targeting sequence
cuacccaccccagacuuguc

SEQ ID NO: 44568 - RNA, 20 nt, Artificial Sequence
  CIITA targeting sequence
ccaccucccuacccacccca

SEQ ID NO: 44569 - RNA, 20 nt, Artificial Sequence
  CIITA targeting sequence
uagaugggagggcagcuggc

SEQ ID NO: 44570 - RNA, 20 nt, Artificial Sequence
  CIITA targeting sequence
aagauccccaccucccuacc

SEQ ID NO: 44571 - RNA, 20 nt, Artificial Sequence
  CIITA targeting sequence
caucuaagauccccaccucc

SEQ ID NO: 44572 - RNA, 20 nt, Artificial Sequence
  CIITA targeting sequence
cggccagcugcccucccauc

SEQ ID NO: 44573 - RNA, 20 nt, Artificial Sequence
  CIITA targeting sequence
cuuucccggccagcugcccu

SEQ ID NO: 44574 - RNA, 20 nt, Artificial Sequence
  CIITA targeting sequence
accacucccuuucccggcca

SEQ ID NO: 44575 - RNA, 20 nt, Artificial Sequence
  CIITA targeting sequence
uucaaccacucccuuucccg

SEQ ID NO: 44576 - RNA, 20 nt, Artificial Sequence
  CIITA targeting sequence
ggaauuuaucgagugggcgg

SEQ ID NO: 44577 - RNA, 20 nt, Artificial Sequence
  CIITA targeting sequence
ugaaauccuucaaccacucc

SEQ ID NO: 44578 - RNA, 20 nt, Artificial Sequence
  CIITA targeting sequence
agugggcggagguggcugag

SEQ ID NO: 44579 - RNA, 20 nt, Artificial Sequence
  CIITA targeting sequence
auaaauuccugaaauccuuc

SEQ ID NO: 44580 - RNA, 20 nt, Artificial Sequence
  CIITA targeting sequence
gcccacucgauaaauuccug

SEQ ID NO: 44581 - RNA, 20 nt, Artificial Sequence
  CIITA targeting sequence
gccaccuccgcccacucgau

SEQ ID NO: 44582 - RNA, 20 nt, Artificial Sequence
  CIITA targeting sequence
ucagccaccuccgcccacuc

SEQ ID NO: 44583 - RNA, 20 nt, Artificial Sequence
  CIITA targeting sequence
ccuccucagccaccuccgcc

SEQ ID NO: 44584 - RNA, 20 nt, Artificial Sequence
  CIITA targeting sequence
ccuccccuccucagccaccu

SEQ ID NO: 44585 - RNA, 20 nt, Artificial Sequence
  CIITA targeting sequence
agaggagguugggccuccug

SEQ ID NO: 44586 - RNA, 20 nt, Artificial Sequence
  CIITA targeting sequence
ggauaacuccccuccccucc

SEQ ID NO: 44587 - RNA, 20 nt, Artificial Sequence
  CIITA targeting sequence
ucuggauaacuccccucccc

SEQ ID NO: 44588 - RNA, 20 nt, Artificial Sequence
  CIITA targeting sequence
ugccggcauccagguaccuc

SEQ ID NO: 44589 - RNA, 20 nt, Artificial Sequence
  CIITA targeting sequence
agguaccuccagguucucac

SEQ ID NO: 44590 - RNA, 20 nt, Artificial Sequence
  CIITA targeting sequence
agguucucaccuaacucugc

SEQ ID NO: 44591 - RNA, 20 nt, Artificial Sequence
  CIITA targeting sequence
caccuaacucugcuuaacuc

SEQ ID NO: 44592 - RNA, 20 nt, Artificial Sequence
  CIITA targeting sequence
ccuaacucugcuuaacucua

SEQ ID NO: 44593 - RNA, 20 nt, Artificial Sequence
  CIITA targeting sequence
gcuuaacucuagcccuuuua

SEQ ID NO: 44594 - RNA, 20 nt, Artificial Sequence
  CIITA targeting sequence
agcccuuuuaaauuaccuua

SEQ ID NO: 44595 - RNA, 20 nt, Artificial Sequence
  CIITA targeting sequence
aaugcauuauucuguaccag

SEQ ID NO: 44596 - RNA, 20 nt, Artificial Sequence
  CIITA targeting sequence
auaaauuaauaaauuaaggu

SEQ ID NO: 44597 - RNA, 20 nt, Artificial Sequence
  CIITA targeting sequence
guaccagguauuugcuaagg

SEQ ID NO: 44598 - RNA, 20 nt, Artificial Sequence
  CIITA targeting sequence
uuagcaaauaccugguacag

SEQ ID NO: 44599 - RNA, 20 nt, Artificial Sequence
  CIITA targeting sequence
cuuaguccucacaagucuga

SEQ ID NO: 44600 - RNA, 20 nt, Artificial Sequence
  CIITA targeting sequence
ucacaagucugaguuacagg

SEQ ID NO: 44601 - RNA, 20 nt, Artificial Sequence
  CIITA targeting sequence
caagucugaguuacaggaac

SEQ ID NO: 44602 - RNA, 20 nt, Artificial Sequence
  CIITA targeting sequence
gaguuacaggaaccauuauu

SEQ ID NO: 44603 - RNA, 20 nt, Artificial Sequence
  CIITA targeting sequence
gacuugugaggacuaaggga

SEQ ID NO: 44604 - RNA, 20 nt, Artificial Sequence
  CIITA targeting sequence
uguaacucagacuugugagg

SEQ ID NO: 44605 - RNA, 20 nt, Artificial Sequence
  CIITA targeting sequence
auuuuacggaaguggaaacu

SEQ ID NO: 44606 - RNA, 20 nt, Artificial Sequence
  CIITA targeting sequence
guaaaauggaaacaauaaug

SEQ ID NO: 44607 - RNA, 20 nt, Artificial Sequence
  CIITA targeting sequence
acuuccguaaaauggaaaca

SEQ ID NO: 44608 - RNA, 20 nt, Artificial Sequence
  CIITA targeting sequence
gggggcuucagugacuugcc

SEQ ID NO: 44609 - RNA, 20 nt, Artificial Sequence
  CIITA targeting sequence
gugacuugcccccagguguc

SEQ ID NO: 44610 - RNA, 20 nt, Artificial Sequence
  CIITA targeting sequence
cugaagcccccugaaccuua

SEQ ID NO: 44611 - RNA, 20 nt, Artificial Sequence
  CIITA targeting sequence
gcagcugaaggguaccagag

SEQ ID NO: 44612 - RNA, 20 nt, Artificial Sequence
  CIITA targeting sequence
gcugcugacaccugggggca

SEQ ID NO: 44613 - RNA, 20 nt, Artificial Sequence
  CIITA targeting sequence
gguacccuucagcugcugac

SEQ ID NO: 44614 - RNA, 20 nt, Artificial Sequence
  CIITA targeting sequence
ugccucugguacccuucagc

SEQ ID NO: 44615 - RNA, 20 nt, Artificial Sequence
  CIITA targeting sequence
aauccugccucugguacccu

SEQ ID NO: 44616 - RNA, 20 nt, Artificial Sequence
  CIITA targeting sequence
cgagcuugugcucauuauac

SEQ ID NO: 44617 - RNA, 20 nt, Artificial Sequence
  CIITA targeting sequence
ggagucaaauccugccucug

SEQ ID NO: 44618 - RNA, 20 nt, Artificial Sequence
  CIITA targeting sequence
uuauacugucuuucugaaua

SEQ ID NO: 44619 - RNA, 20 nt, Artificial Sequence
  CIITA targeting sequence
uucugaauaaaacuucccaa

SEQ ID NO: 44620 - RNA, 20 nt, Artificial Sequence
  CIITA targeting sequence
gaauaaaacuucccaauaag

SEQ ID NO: 44621 - RNA, 20 nt, Artificial Sequence
  CIITA targeting sequence
gaaagacaguauaaugagca

SEQ ID NO: 44622 - RNA, 20 nt, Artificial Sequence
  CIITA targeting sequence
caauaagucuguuugagaac

SEQ ID NO: 44623 - RNA, 20 nt, Artificial Sequence
  CIITA targeting sequence
guuugagaacacuuuugacu

SEQ ID NO: 44624 - RNA, 20 nt, Artificial Sequence
  CIITA targeting sequence
aacagacuuauugggaaguu

SEQ ID NO: 44625 - RNA, 20 nt, Artificial Sequence
  CIITA targeting sequence
caaacagacuuauugggaag

SEQ ID NO: 44626 - RNA, 20 nt, Artificial Sequence
  CIITA targeting sequence
aaaguguucucaaacagacu

SEQ ID NO: 44627 - RNA, 20 nt, Artificial Sequence
  CIITA targeting sequence
gccaagucaaaaguguucuc

SEQ ID NO: 44628 - RNA, 20 nt, Artificial Sequence
  CIITA targeting sequence
caucgccaauggggcaucuu

SEQ ID NO: 44629 - RNA, 20 nt, Artificial Sequence
  CIITA targeting sequence
ucgccaauggggcaucuuug

SEQ ID NO: 44630 - RNA, 20 nt, Artificial Sequence
  CIITA targeting sequence
ccaauggggcaucuuugcca

SEQ ID NO: 44631 - RNA, 20 nt, Artificial Sequence
  CIITA targeting sequence
uugccagccagcagggaaug

SEQ ID NO: 44632 - RNA, 20 nt, Artificial Sequence
  CIITA targeting sequence
cugcuggcuggcaaagaugc

SEQ ID NO: 44633 - RNA, 20 nt, Artificial Sequence
  CIITA targeting sequence
cugguuccuuugcaguaucc

SEQ ID NO: 44634 - RNA, 20 nt, Artificial Sequence
  CIITA targeting sequence
gguuccuuugcaguauccug

SEQ ID NO: 44635 - RNA, 20 nt, Artificial Sequence
  CIITA targeting sequence
uuugcaguauccugggaacu

SEQ ID NO: 44636 - RNA, 20 nt, Artificial Sequence
  CIITA targeting sequence
ugggaacugccuggguucau

SEQ ID NO: 44637 - RNA, 20 nt, Artificial Sequence
  CIITA targeting sequence
caggauacugcaaaggaacc

SEQ ID NO: 44638 - RNA, 20 nt, Artificial Sequence
  CIITA targeting sequence
uuguuuagaucacaugucua

SEQ ID NO: 44639 - RNA, 20 nt, Artificial Sequence
  CIITA targeting sequence
aaacaaugaacccaggcagu

SEQ ID NO: 44640 - RNA, 20 nt, Artificial Sequence
  CIITA targeting sequence
caugucuaucggaugcuucu

SEQ ID NO: 44641 - RNA, 20 nt, Artificial Sequence
  CIITA targeting sequence
aucggaugcuucuuuggaaa

SEQ ID NO: 44642 - RNA, 20 nt, Artificial Sequence
  CIITA targeting sequence
gaugcuucuuuggaaaccca

SEQ ID NO: 44643 - RNA, 20 nt, Artificial Sequence
  CIITA targeting sequence
gauagacaugugaucuaaac

SEQ ID NO: 44644 - RNA, 20 nt, Artificial Sequence
  CIITA targeting sequence
uuggaaacccaaguugccug

SEQ ID NO: 44645 - RNA, 20 nt, Artificial Sequence
  CIITA targeting sequence
aaagaagcauccgauagaca

SEQ ID NO: 44646 - RNA, 20 nt, Artificial Sequence
  CIITA targeting sequence
gggcaggcaacuuggguuuc

SEQ ID NO: 44647 - RNA, 20 nt, Artificial Sequence
  CIITA targeting sequence
ggcagaucagcuuaauccau

SEQ ID NO: 44648 - RNA, 20 nt, Artificial Sequence
  CIITA targeting sequence
gccugauucagggcaggcaa

SEQ ID NO: 44649 - RNA, 20 nt, Artificial Sequence
  CIITA targeting sequence
gcuuaauccauauuacagcc

SEQ ID NO: 44650 - RNA, 20 nt, Artificial Sequence
  CIITA targeting sequence
auauuacagccccaagaacc

SEQ ID NO: 44651 - RNA, 20 nt, Artificial Sequence
  CIITA targeting sequence
uggggcuguaauauggauua

SEQ ID NO: 44652 - RNA, 20 nt, Artificial Sequence
  CIITA targeting sequence
gguucuuggggcuguaauau

SEQ ID NO: 44653 - RNA, 20 nt, Artificial Sequence
  CIITA targeting sequence
cagguucuuggggcuguaau

SEQ ID NO: 44654 - RNA, 20 nt, Artificial Sequence
  CIITA targeting sequence
aacccccccaccaauacaca

SEQ ID NO: 44655 - RNA, 20 nt, Artificial Sequence
  CIITA targeting sequence
ucuaacccccccaccaauac

SEQ ID NO: 44656 - RNA, 20 nt, Artificial Sequence
  CIITA targeting sequence
cccagugacuuggaaaagag

SEQ ID NO: 44657 - RNA, 20 nt, Artificial Sequence
  CIITA targeting sequence
cugggggaucuucuaacccc

SEQ ID NO: 44658 - RNA, 20 nt, Artificial Sequence
  CIITA targeting sequence
aagucacugggggaucuucu

SEQ ID NO: 44659 - RNA, 20 nt, Artificial Sequence
  CIITA targeting sequence
uuuccaagucacugggggau

SEQ ID NO: 44660 - RNA, 20 nt, Artificial Sequence
  CIITA targeting sequence
gcauuuggcucuguugguaa

SEQ ID NO: 44661 - RNA, 20 nt, Artificial Sequence
  CIITA targeting sequence
guugguaaacaucuuggguc

SEQ ID NO: 44662 - RNA, 20 nt, Artificial Sequence
  CIITA targeting sequence
ugggucuuggguacagaaca

SEQ ID NO: 44663 - RNA, 20 nt, Artificial Sequence
  CIITA targeting sequence
uggguacagaacagcucguu

SEQ ID NO: 44664 - RNA, 20 nt, Artificial Sequence
  CIITA targeting sequence
guacccaagacccaagaugu

SEQ ID NO: 44665 - RNA, 20 nt, Artificial Sequence
  CIITA targeting sequence
uucccugagggaguuugcag

SEQ ID NO: 44666 - RNA, 20 nt, Artificial Sequence
  CIITA targeting sequence
cugagggaguuugcaggcug

SEQ ID NO: 44667 - RNA, 20 nt, Artificial Sequence
  CIITA targeting sequence
gggaacgagcuguucuguac

SEQ ID NO: 44668 - RNA, 20 nt, Artificial Sequence
  CIITA targeting sequence
cucagggaacgagcuguucu

SEQ ID NO: 44669 - RNA, 20 nt, Artificial Sequence
  CIITA targeting sequence
cccaccagccugcaaacucc

SEQ ID NO: 44670 - RNA, 20 nt, Artificial Sequence
  CIITA targeting sequence
cccccaccagccugcaaacu

SEQ ID NO: 44671 - RNA, 20 nt, Artificial Sequence
  CIITA targeting sequence
acagcugucucccccaccag

SEQ ID NO: 44672 - RNA, 20 nt, Artificial Sequence
  CIITA targeting sequence
cuggcucuacagcugucucc

SEQ ID NO: 44673 - RNA, 20 nt, Artificial Sequence
  CIITA targeting sequence
cacuguacagucacuggcuc

SEQ ID NO: 44674 - RNA, 20 nt, Artificial Sequence
  CIITA targeting sequence
gcacuuaucacacuguacag

SEQ ID NO: 44675 - RNA, 20 nt, Artificial Sequence
  CIITA targeting sequence
cagcacuuaucacacuguac

SEQ ID NO: 44676 - RNA, 20 nt, Artificial Sequence
  CIITA targeting sequence
ccauggacccaggguucugu

SEQ ID NO: 44677 - RNA, 20 nt, Artificial Sequence
  CIITA targeting sequence
auggcgaucucagcacuuau

SEQ ID NO: 44678 - RNA, 20 nt, Artificial Sequence
  CIITA targeting sequence
gugggaacccuuauugggag

SEQ ID NO: 44679 - RNA, 20 nt, Artificial Sequence
  CIITA targeting sequence
cacagaacccuggguccaug

SEQ ID NO: 44680 - RNA, 20 nt, Artificial Sequence
  CIITA targeting sequence
caauaaggguucccacagaa

SEQ ID NO: 44681 - RNA, 20 nt, Artificial Sequence
  CIITA targeting sequence
ggaggagacaacaccagcgc

SEQ ID NO: 44682 - RNA, 20 nt, Artificial Sequence
  CIITA targeting sequence
agaaagcucccaauaagggu

SEQ ID NO: 44683 - RNA, 20 nt, Artificial Sequence
  CIITA targeting sequence
uccagaaagcucccaauaag

SEQ ID NO: 44684 - RNA, 20 nt, Artificial Sequence
  CIITA targeting sequence
ccuccagaaagcucccaaua

SEQ ID NO: 44685 - RNA, 20 nt, Artificial Sequence
  CIITA targeting sequence
ccaagaaugaacagaagcca

SEQ ID NO: 44686 - RNA, 20 nt, Artificial Sequence
  CIITA targeting sequence
aagaaugaacagaagccacc

SEQ ID NO: 44687 - RNA, 20 nt, Artificial Sequence
  CIITA targeting sequence
uggagaacccgcgcuggugu

SEQ ID NO: 44688 - RNA, 20 nt, Artificial Sequence
  CIITA targeting sequence
uucuuggagaacccgcgcug

SEQ ID NO: 44689 - RNA, 20 nt, Artificial Sequence
  CIITA targeting sequence
guucauucuuggagaacccg

SEQ ID NO: 44690 - RNA, 20 nt, Artificial Sequence
  CIITA targeting sequence
cgccccugcugcccgccaau

SEQ ID NO: 44691 - RNA, 20 nt, Artificial Sequence
  CIITA targeting sequence
gccucccgccccugcugccc

SEQ ID NO: 44692 - RNA, 20 nt, Artificial Sequence
  CIITA targeting sequence
cagugcuccgccucccgccc

SEQ ID NO: 44693 - RNA, 20 nt, Artificial Sequence
  CIITA targeting sequence
uggucacagugcuccgccuc

SEQ ID NO: 44694 - RNA, 20 nt, Artificial Sequence
  CIITA targeting sequence
aggugggggcugauagcugu

SEQ ID NO: 44695 - RNA, 20 nt, Artificial Sequence
  CIITA targeting sequence
gcccccaccuggacaugcca

SEQ ID NO: 44696 - RNA, 20 nt, Artificial Sequence
  CIITA targeting sequence
cacagcuaucagcccccacc

SEQ ID NO: 44697 - RNA, 20 nt, Artificial Sequence
  CIITA targeting sequence
agccuuguuucccacagcua

SEQ ID NO: 44698 - RNA, 20 nt, Artificial Sequence
  CIITA targeting sequence
uacuuccagccuuguuuccc

SEQ ID NO: 44699 - RNA, 20 nt, Artificial Sequence
  CIITA targeting sequence
caagccccuuccuacuucca

SEQ ID NO: 44700 - RNA, 20 nt, Artificial Sequence
  CIITA targeting sequence
gacacuucgggugaccaacc

SEQ ID NO: 44701 - RNA, 20 nt, Artificial Sequence
  CIITA targeting sequence
gauaaaucccaagccccuuc

SEQ ID NO: 44702 - RNA, 20 nt, Artificial Sequence
  CIITA targeting sequence
ggugaccaaccguccugguu

SEQ ID NO: 44703 - RNA, 20 nt, Artificial Sequence
  CIITA targeting sequence
cccgaagugucagauaaauc

SEQ ID NO: 44704 - RNA, 20 nt, Artificial Sequence
  CIITA targeting sequence
ugguuugccugggcugaggg

SEQ ID NO: 44705 - RNA, 20 nt, Artificial Sequence
  CIITA targeting sequence
gcccaggcaaaccaggacgg

SEQ ID NO: 44706 - RNA, 20 nt, Artificial Sequence
  CIITA targeting sequence
caggauaugggacuuucagu

SEQ ID NO: 44707 - RNA, 20 nt, Artificial Sequence
  CIITA targeting sequence
ugggaaaccccucagcccag

SEQ ID NO: 44708 - RNA, 20 nt, Artificial Sequence
  CIITA targeting sequence
cauauccugggaaaccccuc

SEQ ID NO: 44709 - RNA, 20 nt, Artificial Sequence
  CIITA targeting sequence
gugcuaaaacugggaaaguc

SEQ ID NO: 44710 - RNA, 20 nt, Artificial Sequence
  CIITA targeting sequence
caguuuuagcacugaaaguc

SEQ ID NO: 44711 - RNA, 20 nt, Artificial Sequence
  CIITA targeting sequence
uggacaaacuaguauaaacu

SEQ ID NO: 44712 - RNA, 20 nt, Artificial Sequence
  CIITA targeting sequence
aggacuuucccaguuuuagc

SEQ ID NO: 44713 - RNA, 20 nt, Artificial Sequence
  CIITA targeting sequence
cccuaccagugacaagugac

SEQ ID NO: 44714 - RNA, 20 nt, Artificial Sequence
  CIITA targeting sequence
cugguagggugaccaguuua

SEQ ID NO: 44715 - RNA, 20 nt, Artificial Sequence
  CIITA targeting sequence
cuugucacugguagggugac

SEQ ID NO: 44716 - RNA, 20 nt, Artificial Sequence
  CIITA targeting sequence
uaauacacucuuaccuugac

SEQ ID NO: 44717 - RNA, 20 nt, Artificial Sequence
  CIITA targeting sequence
uaccuugaccuagagcagua

SEQ ID NO: 44718 - RNA, 20 nt, Artificial Sequence
  CIITA targeting sequence
agguaagaguguauuaagaa

SEQ ID NO: 44719 - RNA, 20 nt, Artificial Sequence
  CIITA targeting sequence
aggucaagguaagaguguau

SEQ ID NO: 44720 - RNA, 20 nt, Artificial Sequence
  CIITA targeting sequence
auacugcucuaggucaaggu

SEQ ID NO: 44721 - RNA, 20 nt, Artificial Sequence
  CIITA targeting sequence
auccauacugcucuagguca

SEQ ID NO: 44722 - RNA, 20 nt, Artificial Sequence
  CIITA targeting sequence
ccauccauacugcucuaggu

SEQ ID NO: 44723 - RNA, 20 nt, Artificial Sequence
  CIITA targeting sequence
cucuccauccauacugcucu

SEQ ID NO: 44724 - RNA, 20 nt, Artificial Sequence
  CIITA targeting sequence
uaaacuuucccucuccaucc

SEQ ID NO: 44725 - RNA, 20 nt, Artificial Sequence
  CIITA targeting sequence
uuuaacuaucuuaaacuuuc

SEQ ID NO: 44726 - RNA, 20 nt, Artificial Sequence
  CIITA targeting sequence
ggaaacccucuucuuuuuuu

SEQ ID NO: 44727 - RNA, 20 nt, Artificial Sequence
  CIITA targeting sequence
agaugccuuguguauuuaaa

SEQ ID NO: 44728 - RNA, 20 nt, Artificial Sequence
  CIITA targeting sequence
ucuuuuuuuuuuugagauaa

SEQ ID NO: 44729 - RNA, 20 nt, Artificial Sequence
  CIITA targeting sequence
uuuuuuuuuugagauaagag

SEQ ID NO: 44730 - RNA, 20 nt, Artificial Sequence
  CIITA targeting sequence
aaaaaaaaaagaagaggguu

SEQ ID NO: 44731 - RNA, 20 nt, Artificial Sequence
  CIITA targeting sequence
caaaaaaaaaaagaagaggg

SEQ ID NO: 44732 - RNA, 20 nt, Artificial Sequence
  CIITA targeting sequence
uaucucaaaaaaaaaaagaa

SEQ ID NO: 44733 - RNA, 20 nt, Artificial Sequence
  CIITA targeting sequence
ugcucuguugcccaggcugg

SEQ ID NO: 44734 - RNA, 20 nt, Artificial Sequence
  CIITA targeting sequence
guugcccaggcuggagugca

SEQ ID NO: 44735 - RNA, 20 nt, Artificial Sequence
  CIITA targeting sequence
agccugggcaacagagcaag

SEQ ID NO: 44736 - RNA, 20 nt, Artificial Sequence
  CIITA targeting sequence
ugccacugcacuccagccug

SEQ ID NO: 44737 - RNA, 20 nt, Artificial Sequence
  CIITA targeting sequence
uggcucacugcaagcuccgc

SEQ ID NO: 44738 - RNA, 20 nt, Artificial Sequence
  CIITA targeting sequence
cugcaagcuccgccucccgg

SEQ ID NO: 44739 - RNA, 20 nt, Artificial Sequence
  CIITA targeting sequence
gccucccggguucacgccau

SEQ ID NO: 44740 - RNA, 20 nt, Artificial Sequence
  CIITA targeting sequence
cggguucacgccauucuccu

SEQ ID NO: 44741 - RNA, 20 nt, Artificial Sequence
  CIITA targeting sequence
cgccauucuccugccucagc

SEQ ID NO: 44742 - RNA, 20 nt, Artificial Sequence
  CIITA targeting sequence
ccugccucagccuccagagu

SEQ ID NO: 44743 - RNA, 20 nt, Artificial Sequence
  CIITA targeting sequence
ugccucagccuccagaguag

SEQ ID NO: 44744 - RNA, 20 nt, Artificial Sequence
  CIITA targeting sequence
gccuccagaguagcugggac

SEQ ID NO: 44745 - RNA, 20 nt, Artificial Sequence
  CIITA targeting sequence
agaguagcugggacuacagg

SEQ ID NO: 44746 - RNA, 20 nt, Artificial Sequence
  CIITA targeting sequence
ggaggcugaggcaggagaau

SEQ ID NO: 44747 - RNA, 20 nt, Artificial Sequence
  CIITA targeting sequence
cagcuacucuggaggcugag

SEQ ID NO: 44748 - RNA, 20 nt, Artificial Sequence
  CIITA targeting sequence
acuaaaaauacaaaaaauua

SEQ ID NO: 44749 - RNA, 20 nt, Artificial Sequence
  CIITA targeting sequence
cuacuaaaaauacaaaaaau

SEQ ID NO: 44750 - RNA, 20 nt, Artificial Sequence
  CIITA targeting sequence
ccguguuagccaggaugguc

SEQ ID NO: 44751 - RNA, 20 nt, Artificial Sequence
  CIITA targeting sequence
uggcuaacacggugaaaccc

SEQ ID NO: 44752 - RNA, 20 nt, Artificial Sequence
  CIITA targeting sequence
cgaucuccugaccuugugau

SEQ ID NO: 44753 - RNA, 20 nt, Artificial Sequence
  CIITA targeting sequence
aucuccugaccuugugaucu

SEQ ID NO: 44754 - RNA, 20 nt, Artificial Sequence
  CIITA targeting sequence
agaccauccuggcuaacacg

SEQ ID NO: 44755 - RNA, 20 nt, Artificial Sequence
  CIITA targeting sequence
ccugaccuugugaucugccc

SEQ ID NO: 44756 - RNA, 20 nt, Artificial Sequence
  CIITA targeting sequence
ugaccuugugaucugcccuc

SEQ ID NO: 44757 - RNA, 20 nt, Artificial Sequence
  CIITA targeting sequence
ggagaucgagaccauccugg

SEQ ID NO: 44758 - RNA, 20 nt, Artificial Sequence
  CIITA targeting sequence
caaggucaggagaucgagac

SEQ ID NO: 44759 - RNA, 20 nt, Artificial Sequence
  CIITA targeting sequence
gcccuccuugaccucccaaa

SEQ ID NO: 44760 - RNA, 20 nt, Artificial Sequence
  CIITA targeting sequence
uugaccucccaaagugcugg

SEQ ID NO: 44761 - RNA, 20 nt, Artificial Sequence
  CIITA targeting sequence
aggagggcagaucacaaggu

SEQ ID NO: 44762 - RNA, 20 nt, Artificial Sequence
  CIITA targeting sequence
caaagugcugggauuacagg

SEQ ID NO: 44763 - RNA, 20 nt, Artificial Sequence
  CIITA targeting sequence
cagcacuuugggaggucaag

SEQ ID NO: 44764 - RNA, 20 nt, Artificial Sequence
  CIITA targeting sequence
ugccuguaaucccagcacuu

SEQ ID NO: 44765 - RNA, 20 nt, Artificial Sequence
  CIITA targeting sequence
aggccgggugcaguggcuca

SEQ ID NO: 44766 - RNA, 20 nt, Artificial Sequence
  CIITA targeting sequence
aaaaaaguaaagucuaggcc

SEQ ID NO: 44767 - RNA, 20 nt, Artificial Sequence
  CIITA targeting sequence
aacuguucuaaaaaaguaaa

SEQ ID NO: 44768 - RNA, 20 nt, Artificial Sequence
  CIITA targeting sequence
caaacuguucuaaaaaagua

SEQ ID NO: 44769 - RNA, 20 nt, Artificial Sequence
  CIITA targeting sequence
guaaaucucaaacuguucua

SEQ ID NO: 44770 - RNA, 20 nt, Artificial Sequence
  CIITA targeting sequence
accuuucuguaaaucucaaa

SEQ ID NO: 44771 - RNA, 20 nt, Artificial Sequence
  CIITA targeting sequence
caaccuuucuguaaaucuca

SEQ ID NO: 44772 - RNA, 20 nt, Artificial Sequence
  CIITA targeting sequence
ucucaaccuuucuguaaauc

SEQ ID NO: 44773 - RNA, 20 nt, Artificial Sequence
  CIITA targeting sequence
gugcuaucuucucaaccuuu

SEQ ID NO: 44774 - RNA, 20 nt, Artificial Sequence
  CIITA targeting sequence
cugugcuaucuucucaaccu

SEQ ID NO: 44775 - RNA, 20 nt, Artificial Sequence
  CIITA targeting sequence
agcucucugugcuaucuucu

SEQ ID NO: 44776 - RNA, 20 nt, Artificial Sequence
  CIITA targeting sequence
uuauucuuuguaacacuccc

SEQ ID NO: 44777 - RNA, 20 nt, Artificial Sequence
  CIITA targeting sequence
uuguaacacucccagcuugc

SEQ ID NO: 44778 - RNA, 20 nt, Artificial Sequence
  CIITA targeting sequence
cagcuugcaaacuggaaagg

SEQ ID NO: 44779 - RNA, 20 nt, Artificial Sequence
  CIITA targeting sequence
aguuugcaagcugggagugu

SEQ ID NO: 44780 - RNA, 20 nt, Artificial Sequence
  CIITA targeting sequence
uuuccaguuugcaagcuggg

SEQ ID NO: 44781 - RNA, 20 nt, Artificial Sequence
  CIITA targeting sequence
uguuaggguuuuacuuuugc

SEQ ID NO: 44782 - RNA, 20 nt, Artificial Sequence
  CIITA targeting sequence
accauuuagcaaaaguaaaa

SEQ ID NO: 44783 - RNA, 20 nt, Artificial Sequence
  CIITA targeting sequence
uaccuguggucucugucugc

SEQ ID NO: 44784 - RNA, 20 nt, Artificial Sequence
  CIITA targeting sequence
cugucugcugaacugaguua

SEQ ID NO: 44785 - RNA, 20 nt, Artificial Sequence
  CIITA targeting sequence
gucugcugaacugaguuagu

SEQ ID NO: 44786 - RNA, 20 nt, Artificial Sequence
  CIITA targeting sequence
gcugaacugaguuagugauu

SEQ ID NO: 44787 - RNA, 20 nt, Artificial Sequence
  CIITA targeting sequence
gcagacagagaccacaggua

SEQ ID NO: 44788 - RNA, 20 nt, Artificial Sequence
  CIITA targeting sequence
guucagcagacagagaccac

SEQ ID NO: 44789 - RNA, 20 nt, Artificial Sequence
  CIITA targeting sequence
cuaacucaguucagcagaca

SEQ ID NO: 44790 - RNA, 20 nt, Artificial Sequence
  CIITA targeting sequence
ggcagauugaaguagucaag

SEQ ID NO: 44791 - RNA, 20 nt, Artificial Sequence
  CIITA targeting sequence
gccugagcuaaaucacuaac

SEQ ID NO: 44792 - RNA, 20 nt, Artificial Sequence
  CIITA targeting sequence
aucugccugagcuaaaucac

SEQ ID NO: 44793 - RNA, 20 nt, Artificial Sequence
  CIITA targeting sequence
agagguuauuugcuacacac

SEQ ID NO: 44794 - RNA, 20 nt, Artificial Sequence
  CIITA targeting sequence
ugacuacuucaaucugccug

SEQ ID NO: 44795 - RNA, 20 nt, Artificial Sequence
  CIITA targeting sequence
agauuaguggcaaggcugug

SEQ ID NO: 44796 - RNA, 20 nt, Artificial Sequence
  CIITA targeting sequence
ggacaauaaaccacccaugg

SEQ ID NO: 44797 - RNA, 20 nt, Artificial Sequence
  CIITA targeting sequence
cagccuugccacuaaucugg

SEQ ID NO: 44798 - RNA, 20 nt, Artificial Sequence
  CIITA targeting sequence
augucacagccuugccacua

SEQ ID NO: 44799 - RNA, 20 nt, Artificial Sequence
  CIITA targeting sequence
gucaaugucacagccuugcc

SEQ ID NO: 44800 - RNA, 20 nt, Artificial Sequence
  CIITA targeting sequence
accaccaagcggaagccuga

SEQ ID NO: 44801 - RNA, 20 nt, Artificial Sequence
  CIITA targeting sequence
gcuuggugguggacauuugu

SEQ ID NO: 44802 - RNA, 20 nt, Artificial Sequence
  CIITA targeting sequence
ggcuuccgcuugguggugga

SEQ ID NO: 44803 - RNA, 20 nt, Artificial Sequence
  CIITA targeting sequence
cucaggcuuccgcuuggugg

SEQ ID NO: 44804 - RNA, 20 nt, Artificial Sequence
  CIITA targeting sequence
aucacucaggcuuccgcuug

SEQ ID NO: 44805 - RNA, 20 nt, Artificial Sequence
  CIITA targeting sequence
uuugauugcuacugaaacau

SEQ ID NO: 44806 - RNA, 20 nt, Artificial Sequence
  CIITA targeting sequence
aacgauuccaucacucaggc

SEQ ID NO: 44807 - RNA, 20 nt, Artificial Sequence
  CIITA targeting sequence
guagcaaucaaacgauucca

SEQ ID NO: 44808 - RNA, 20 nt, Artificial Sequence
  CIITA targeting sequence
ucuuuaccagggacugcaag

SEQ ID NO: 44809 - RNA, 20 nt, Artificial Sequence
  CIITA targeting sequence
uuaccagggacugcaagucu

SEQ ID NO: 44810 - RNA, 20 nt, Artificial Sequence
  CIITA targeting sequence
cugguaaagaugauguuuca

SEQ ID NO: 44811 - RNA, 20 nt, Artificial Sequence
  CIITA targeting sequence
gcggcugguagaaauugguc

SEQ ID NO: 44812 - RNA, 20 nt, Artificial Sequence
  CIITA targeting sequence
accagccgcagacuugcagu

SEQ ID NO: 44813 - RNA, 20 nt, Artificial Sequence
  CIITA targeting sequence
uuuuuguauuguggccuuca

SEQ ID NO: 44814 - RNA, 20 nt, Artificial Sequence
  CIITA targeting sequence
uucugguccacuuugugugg

SEQ ID NO: 44815 - RNA, 20 nt, Artificial Sequence
  CIITA targeting sequence
gguccacuuugugugggggu

SEQ ID NO: 44816 - RNA, 20 nt, Artificial Sequence
  CIITA targeting sequence
acuuugugugggggucaaga

SEQ ID NO: 44817 - RNA, 20 nt, Artificial Sequence
  CIITA targeting sequence
agauuuuugguuccagugac

SEQ ID NO: 44818 - RNA, 20 nt, Artificial Sequence
  CIITA targeting sequence
ugacccccacacaaagugga

SEQ ID NO: 44819 - RNA, 20 nt, Artificial Sequence
  CIITA targeting sequence
agugacagaaacccagcuag

SEQ ID NO: 44820 - RNA, 20 nt, Artificial Sequence
  CIITA targeting sequence
cuggaaccaaaaaucuugac

SEQ ID NO: 44821 - RNA, 20 nt, Artificial Sequence
  CIITA targeting sequence
gucacuggaaccaaaaaucu

SEQ ID NO: 44822 - RNA, 20 nt, Artificial Sequence
  CIITA targeting sequence
agcuggguuucugucacugg

SEQ ID NO: 44823 - RNA, 20 nt, Artificial Sequence
  CIITA targeting sequence
aauggauugaauagcucaug

SEQ ID NO: 44824 - RNA, 20 nt, Artificial Sequence
  CIITA targeting sequence
auuugaggcuuaaggcaauu

SEQ ID NO: 44825 - RNA, 20 nt, Artificial Sequence
  CIITA targeting sequence
auccauuugaggcuuaaggc

SEQ ID NO: 44826 - RNA, 20 nt, Artificial Sequence
  CIITA targeting sequence
ugucacugaauggucugucc

SEQ ID NO: 44827 - RNA, 20 nt, Artificial Sequence
  CIITA targeting sequence
cugaauggucuguccccgcu

SEQ ID NO: 44828 - RNA, 20 nt, Artificial Sequence
  CIITA targeting sequence
gugacaugagcuauucaauc

SEQ ID NO: 44829 - RNA, 20 nt, Artificial Sequence
  CIITA targeting sequence
guccccgcuaaaccauggcu

SEQ ID NO: 44830 - RNA, 20 nt, Artificial Sequence
  CIITA targeting sequence
ccgcuaaaccauggcugaau

SEQ ID NO: 44831 - RNA, 20 nt, Artificial Sequence
  CIITA targeting sequence
gccaugguuuagcggggaca

SEQ ID NO: 44832 - RNA, 20 nt, Artificial Sequence
  CIITA targeting sequence
agguguuuggagccgucaga

SEQ ID NO: 44833 - RNA, 20 nt, Artificial Sequence
  CIITA targeting sequence
aaacaccuggauucagccau

SEQ ID NO: 44834 - RNA, 20 nt, Artificial Sequence
  CIITA targeting sequence
gaaaucggccuuuuuccacc

SEQ ID NO: 44835 - RNA, 20 nt, Artificial Sequence
  CIITA targeting sequence
gacggcuccaaacaccugga

SEQ ID NO: 44836 - RNA, 20 nt, Artificial Sequence
  CIITA targeting sequence
gccuuuuuccaccuuucagc

SEQ ID NO: 44837 - RNA, 20 nt, Artificial Sequence
  CIITA targeting sequence
accuuucagcucuaccuuuu

SEQ ID NO: 44838 - RNA, 20 nt, Artificial Sequence
  CIITA targeting sequence
gcucuaccuuuuuccuguug

SEQ ID NO: 44839 - RNA, 20 nt, Artificial Sequence
  CIITA targeting sequence
accuuuuuccuguugguguc

SEQ ID NO: 44840 - RNA, 20 nt, Artificial Sequence
  CIITA targeting sequence
uguuggugucauuuucaggc

SEQ ID NO: 44841 - RNA, 20 nt, Artificial Sequence
  CIITA targeting sequence
uuuucaggcaggcugcaggc

SEQ ID NO: 44842 - RNA, 20 nt, Artificial Sequence
  CIITA targeting sequence
ggcaggcugcaggcuuacau

SEQ ID NO: 44843 - RNA, 20 nt, Artificial Sequence
  CIITA targeting sequence
uaucagcuuagcauuccuga

SEQ ID NO: 44844 - RNA, 20 nt, Artificial Sequence
  CIITA targeting sequence
gcuuagcauuccugaggaaa

SEQ ID NO: 44845 - RNA, 20 nt, Artificial Sequence
  CIITA targeting sequence
ugaggaaaaagagagcuucu

SEQ ID NO: 44846 - RNA, 20 nt, Artificial Sequence
  CIITA targeting sequence
ggaaugcuaagcugauauga

SEQ ID NO: 44847 - RNA, 20 nt, Artificial Sequence
  CIITA targeting sequence
ucaggaaugcuaagcugaua

SEQ ID NO: 44848 - RNA, 20 nt, Artificial Sequence
  CIITA targeting sequence
uuuuccucaggaaugcuaag

SEQ ID NO: 44849 - RNA, 20 nt, Artificial Sequence
  CIITA targeting sequence
cuuuuuccucaggaaugcua

SEQ ID NO: 44850 - RNA, 20 nt, Artificial Sequence
  CIITA targeting sequence
uuucucaauauugccagcag

SEQ ID NO: 44851 - RNA, 20 nt, Artificial Sequence
  CIITA targeting sequence
caauauugccagcagaaguc

SEQ ID NO: 44852 - RNA, 20 nt, Artificial Sequence
  CIITA targeting sequence
auauugccagcagaagucca

SEQ ID NO: 44853 - RNA, 20 nt, Artificial Sequence
  CIITA targeting sequence
gcuggcaauauugagaaaag

SEQ ID NO: 44854 - RNA, 20 nt, Artificial Sequence
  CIITA targeting sequence
agaauugagauugaguaucc

SEQ ID NO: 44855 - RNA, 20 nt, Artificial Sequence
  CIITA targeting sequence
ggacuucugcuggcaauauu

SEQ ID NO: 44856 - RNA, 20 nt, Artificial Sequence
  CIITA targeting sequence
auucuggacuucugcuggca

SEQ ID NO: 44857 - RNA, 20 nt, Artificial Sequence
  CIITA targeting sequence
caauucuggacuucugcugg

SEQ ID NO: 44858 - RNA, 20 nt, Artificial Sequence
  CIITA targeting sequence
aucucaauucuggacuucug

SEQ ID NO: 44859 - RNA, 20 nt, Artificial Sequence
  CIITA targeting sequence
cuggaccagcaaggucucau

SEQ ID NO: 44860 - RNA, 20 nt, Artificial Sequence
  CIITA targeting sequence
agggauacucaaucucaauu

SEQ ID NO: 44861 - RNA, 20 nt, Artificial Sequence
  CIITA targeting sequence
caugccaccccugaacuguc

SEQ ID NO: 44862 - RNA, 20 nt, Artificial Sequence
  CIITA targeting sequence
ugccaccccugaacugucac

SEQ ID NO: 44863 - RNA, 20 nt, Artificial Sequence
  CIITA targeting sequence
gggguggcaugagaccuugc

SEQ ID NO: 44864 - RNA, 20 nt, Artificial Sequence
  CIITA targeting sequence
cucuggccaaagguauaggg

SEQ ID NO: 44865 - RNA, 20 nt, Artificial Sequence
  CIITA targeting sequence
ggccaaagguauagggggau

SEQ ID NO: 44866 - RNA, 20 nt, Artificial Sequence
  CIITA targeting sequence
cccuauaccuuuggccagag

SEQ ID NO: 44867 - RNA, 20 nt, Artificial Sequence
  CIITA targeting sequence
gauuggccauuccucacuca

SEQ ID NO: 44868 - RNA, 20 nt, Artificial Sequence
  CIITA targeting sequence
gaucccccuauaccuuuggc

SEQ ID NO: 44869 - RNA, 20 nt, Artificial Sequence
  CIITA targeting sequence
ucacucauauucccuucccu

SEQ ID NO: 44870 - RNA, 20 nt, Artificial Sequence
  CIITA targeting sequence
cucauauucccuucccugga

SEQ ID NO: 44871 - RNA, 20 nt, Artificial Sequence
  CIITA targeting sequence
uauucccuucccuggagcaa

SEQ ID NO: 44872 - RNA, 20 nt, Artificial Sequence
  CIITA targeting sequence
cuucccuggagcaagagugg

SEQ ID NO: 44873 - RNA, 20 nt, Artificial Sequence
  CIITA targeting sequence
cuggagcaagagugggauua

SEQ ID NO: 44874 - RNA, 20 nt, Artificial Sequence
  CIITA targeting sequence
agggaagggaauaugaguga

SEQ ID NO: 44875 - RNA, 20 nt, Artificial Sequence
  CIITA targeting sequence
ugcuccagggaagggaauau

SEQ ID NO: 44876 - RNA, 20 nt, Artificial Sequence
  CIITA targeting sequence
cacucuugcuccagggaagg

SEQ ID NO: 44877 - RNA, 20 nt, Artificial Sequence
  CIITA targeting sequence
acucaagcuaguggaaaaga

SEQ ID NO: 44878 - RNA, 20 nt, Artificial Sequence
  CIITA targeting sequence
agcuaguggaaaagaaugag

SEQ ID NO: 44879 - RNA, 20 nt, Artificial Sequence
  CIITA targeting sequence
acuagcuugaguggagcuaa

SEQ ID NO: 44880 - RNA, 20 nt, Artificial Sequence
  CIITA targeting sequence
uuuccacuagcuugagugga

SEQ ID NO: 44881 - RNA, 20 nt, Artificial Sequence
  CIITA targeting sequence
uucuuuuccacuagcuugag

SEQ ID NO: 44882 - RNA, 20 nt, Artificial Sequence
  CIITA targeting sequence
cauucuuuuccacuagcuug

SEQ ID NO: 44883 - RNA, 20 nt, Artificial Sequence
  CIITA targeting sequence
cucauucuuuuccacuagcu

SEQ ID NO: 44884 - RNA, 20 nt, Artificial Sequence
  CIITA targeting sequence
uuucucucauucuuuuccac

SEQ ID NO: 44885 - RNA, 20 nt, Artificial Sequence
  CIITA targeting sequence
ccaugggagaaucagggguu

SEQ ID NO: 44886 - RNA, 20 nt, Artificial Sequence
  CIITA targeting sequence
cauggggaaccacucuuuuc

SEQ ID NO: 44887 - RNA, 20 nt, Artificial Sequence
  CIITA targeting sequence
cccauggggaaccacucuuu

SEQ ID NO: 44888 - RNA, 20 nt, Artificial Sequence
  CIITA targeting sequence
gggguuauugcccaaagaag

SEQ ID NO: 44889 - RNA, 20 nt, Artificial Sequence
  CIITA targeting sequence
uugggcaauaaccccugauu

SEQ ID NO: 44890 - RNA, 20 nt, Artificial Sequence
  CIITA targeting sequence
gccuucuuugggcaauaacc

SEQ ID NO: 44891 - RNA, 20 nt, Artificial Sequence
  CIITA targeting sequence
ccgccuucuuugggcaauaa

SEQ ID NO: 44892 - RNA, 20 nt, Artificial Sequence
  CIITA targeting sequence
auucuccgccuucuuugggc

SEQ ID NO: 44893 - RNA, 20 nt, Artificial Sequence
  CIITA targeting sequence
auggcagguagacagacgca

SEQ ID NO: 44894 - RNA, 20 nt, Artificial Sequence
  CIITA targeting sequence
accugccauggauccauucu

SEQ ID NO: 44895 - RNA, 20 nt, Artificial Sequence
  CIITA targeting sequence
gucuaccugccauggaucca

SEQ ID NO: 44896 - RNA, 20 nt, Artificial Sequence
  CIITA targeting sequence
uggugcuuucaaguuuuggc

SEQ ID NO: 44897 - RNA, 20 nt, Artificial Sequence
  CIITA targeting sequence
aguuuuggcuaagguggcac

SEQ ID NO: 44898 - RNA, 20 nt, Artificial Sequence
  CIITA targeting sequence
gugccaccuuagccaaaacu

SEQ ID NO: 44899 - RNA, 20 nt, Artificial Sequence
  CIITA targeting sequence
aacacugucagugccaccuu

SEQ ID NO: 44900 - RNA, 20 nt, Artificial Sequence
  CIITA targeting sequence
acauggcaauauuguacccc

SEQ ID NO: 44901 - RNA, 20 nt, Artificial Sequence
  CIITA targeting sequence
uaaaauaucgucuucaccau

SEQ ID NO: 44902 - RNA, 20 nt, Artificial Sequence
  CIITA targeting sequence
ucuucaccaugccacauauu

SEQ ID NO: 44903 - RNA, 20 nt, Artificial Sequence
  CIITA targeting sequence
ucaccaugccacauauuaug

SEQ ID NO: 44904 - RNA, 20 nt, Artificial Sequence
  CIITA targeting sequence
ccaugccacauauuaugggu

SEQ ID NO: 44905 - RNA, 20 nt, Artificial Sequence
  CIITA targeting sequence
uaggcucccacuaugucacg

SEQ ID NO: 44906 - RNA, 20 nt, Artificial Sequence
  CIITA targeting sequence
cacuaugucacgucuaaguu

SEQ ID NO: 44907 - RNA, 20 nt, Artificial Sequence
  CIITA targeting sequence
cgucuaaguucuuccaggcc

SEQ ID NO: 44908 - RNA, 20 nt, Artificial Sequence
  CIITA targeting sequence
aaguucuuccaggccuuccc

SEQ ID NO: 44909 - RNA, 20 nt, Artificial Sequence
  CIITA targeting sequence
uccaggccuucccaccaucu

SEQ ID NO: 44910 - RNA, 20 nt, Artificial Sequence
  CIITA targeting sequence
aggccuucccaccaucuagu

SEQ ID NO: 44911 - RNA, 20 nt, Artificial Sequence
  CIITA targeting sequence
caccaucuaguuugggagca

SEQ ID NO: 44912 - RNA, 20 nt, Artificial Sequence
  CIITA targeting sequence
aguuugggagcacagggagu

SEQ ID NO: 44913 - RNA, 20 nt, Artificial Sequence
  CIITA targeting sequence
caaacuagauggugggaagg

SEQ ID NO: 44914 - RNA, 20 nt, Artificial Sequence
  CIITA targeting sequence
cugugcucccaaacuagaug

SEQ ID NO: 44915 - RNA, 20 nt, Artificial Sequence
  CIITA targeting sequence
uaacucccugugcucccaaa

SEQ ID NO: 44916 - RNA, 20 nt, Artificial Sequence
  CIITA targeting sequence
uuguuaggcagacgcuguuu

SEQ ID NO: 44917 - RNA, 20 nt, Artificial Sequence
  CIITA targeting sequence
gccuaacaaggauguuccua

SEQ ID NO: 44918 - RNA, 20 nt, Artificial Sequence
  CIITA targeting sequence
auuuaaacagcgucugccua

SEQ ID NO: 44919 - RNA, 20 nt, Artificial Sequence
  CIITA targeting sequence
ccauuuaaacagcgucugcc

SEQ ID NO: 44920 - RNA, 20 nt, Artificial Sequence
  CIITA targeting sequence
ccccguuggucuccauuuaa

SEQ ID NO: 44921 - RNA, 20 nt, Artificial Sequence
  CIITA targeting sequence
uuguuaccaggcagcggggu

SEQ ID NO: 44922 - RNA, 20 nt, Artificial Sequence
  CIITA targeting sequence
gguggaaggaaggauguuuc

SEQ ID NO: 44923 - RNA, 20 nt, Artificial Sequence
  CIITA targeting sequence
accugacaccccgcugccug

SEQ ID NO: 44924 - RNA, 20 nt, Artificial Sequence
  CIITA targeting sequence
uuccaccugacaccccgcug

SEQ ID NO: 44925 - RNA, 20 nt, Artificial Sequence
  CIITA targeting sequence
uuccuuccaccugacacccc

SEQ ID NO: 44926 - RNA, 20 nt, Artificial Sequence
  CIITA targeting sequence
ggcagaggaaaaggcauuug

SEQ ID NO: 44927 - RNA, 20 nt, Artificial Sequence
  CIITA targeting sequence
gccugaaacauccuuccuuc

SEQ ID NO: 44928 - RNA, 20 nt, Artificial Sequence
  CIITA targeting sequence
ucugccugaaacauccuucc

SEQ ID NO: 44929 - RNA, 20 nt, Artificial Sequence
  CIITA targeting sequence
aaugccuuuuccucugccug

SEQ ID NO: 44930 - RNA, 20 nt, Artificial Sequence
  CIITA targeting sequence
caaaugccuuuuccucugcc

SEQ ID NO: 44931 - RNA, 20 nt, Artificial Sequence
  CIITA targeting sequence
ccuugccccacuaggcuuuc

SEQ ID NO: 44932 - RNA, 20 nt, Artificial Sequence
  CIITA targeting sequence
gccaaugugcacugcucccc

SEQ ID NO: 44933 - RNA, 20 nt, Artificial Sequence
  CIITA targeting sequence
cgugguucagcaggggagug

SEQ ID NO: 44934 - RNA, 20 nt, Artificial Sequence
  CIITA targeting sequence
gcaggggaguguucacuggg

SEQ ID NO: 44935 - RNA, 20 nt, Artificial Sequence
  CIITA targeting sequence
ccugcugaaccacgugaguu

SEQ ID NO: 44936 - RNA, 20 nt, Artificial Sequence
  CIITA targeting sequence
cugggugaagaggaagugag

SEQ ID NO: 44937 - RNA, 20 nt, Artificial Sequence
  CIITA targeting sequence
cccagugaacacuccccugc

SEQ ID NO: 44938 - RNA, 20 nt, Artificial Sequence
  CIITA targeting sequence
ucacccagugaacacucccc

SEQ ID NO: 44939 - RNA, 20 nt, Artificial Sequence
  CIITA targeting sequence
ucuucacccagugaacacuc

SEQ ID NO: 44940 - RNA, 20 nt, Artificial Sequence
  CIITA targeting sequence
cuuccucuucacccagugaa

SEQ ID NO: 44941 - RNA, 20 nt, Artificial Sequence
  CIITA targeting sequence
ucacuuccucuucacccagu

SEQ ID NO: 44942 - RNA, 20 nt, Artificial Sequence
  CIITA targeting sequence
gagccaugcuuggcagucuc

SEQ ID NO: 44943 - RNA, 20 nt, Artificial Sequence
  CIITA targeting sequence
gagcuuggguccucacuucc

SEQ ID NO: 44944 - RNA, 20 nt, Artificial Sequence
  CIITA targeting sequence
ccagaggccagguccccugg

SEQ ID NO: 44945 - RNA, 20 nt, Artificial Sequence
  CIITA targeting sequence
agaggccagguccccugggg

SEQ ID NO: 44946 - RNA, 20 nt, Artificial Sequence
  CIITA targeting sequence
ggagacugccaagcauggcu

SEQ ID NO: 44947 - RNA, 20 nt, Artificial Sequence
  CIITA targeting sequence
ccuggggcccuguaaaucac

SEQ ID NO: 44948 - RNA, 20 nt, Artificial Sequence
  CIITA targeting sequence
cuuuaaggaauucagacuau

SEQ ID NO: 44949 - RNA, 20 nt, Artificial Sequence
  CIITA targeting sequence
uuaaagugauuuacagggcc

SEQ ID NO: 44950 - RNA, 20 nt, Artificial Sequence
  CIITA targeting sequence
gacuaugagugagaacagua

SEQ ID NO: 44951 - RNA, 20 nt, Artificial Sequence
  CIITA targeting sequence
gaauuccuuaaagugauuua

SEQ ID NO: 44952 - RNA, 20 nt, Artificial Sequence
  CIITA targeting sequence
uagucugaauuccuuaaagu

SEQ ID NO: 44953 - RNA, 20 nt, Artificial Sequence
  CIITA targeting sequence
cucauagucugaauuccuua

SEQ ID NO: 44954 - RNA, 20 nt, Artificial Sequence
  CIITA targeting sequence
cacucauagucugaauuccu

SEQ ID NO: 44955 - RNA, 20 nt, Artificial Sequence
  CIITA targeting sequence
cuacuguucucacucauagu

SEQ ID NO: 44956 - RNA, 20 nt, Artificial Sequence
  CIITA targeting sequence
guggcucccuacuguucuca

SEQ ID NO: 44957 - RNA, 20 nt, Artificial Sequence
  CIITA targeting sequence
guaguuaaaaaaccuucagu

SEQ ID NO: 44958 - RNA, 20 nt, Artificial Sequence
  CIITA targeting sequence
ggcugaagcuggcagaaugg

SEQ ID NO: 44959 - RNA, 20 nt, Artificial Sequence
  CIITA targeting sequence
gccagaccacagccuuucug

SEQ ID NO: 44960 - RNA, 20 nt, Artificial Sequence
  CIITA targeting sequence
gccagcuucagccagaccac

SEQ ID NO: 44961 - RNA, 20 nt, Artificial Sequence
  CIITA targeting sequence
auucugccagcuucagccag

SEQ ID NO: 44962 - RNA, 20 nt, Artificial Sequence
  CIITA targeting sequence
aauccauucugccagcuuca

SEQ ID NO: 44963 - RNA, 20 nt, Artificial Sequence
  CIITA targeting sequence
uccaauccauucugccagcu

SEQ ID NO: 44964 - RNA, 20 nt, Artificial Sequence
  CIITA targeting sequence
gccccucauccaauccauuc

SEQ ID NO: 44965 - RNA, 20 nt, Artificial Sequence
  CIITA targeting sequence
agucugccccucauccaauc

SEQ ID NO: 44966 - RNA, 20 nt, Artificial Sequence
  CIITA targeting sequence
acauguguugguggggcggg

SEQ ID NO: 44967 - RNA, 20 nt, Artificial Sequence
  CIITA targeting sequence
ccgccccaccaacacaugug

SEQ ID NO: 44968 - RNA, 20 nt, Artificial Sequence
  CIITA targeting sequence
gcugccguccccuggugagu

SEQ ID NO: 44969 - RNA, 20 nt, Artificial Sequence
  CIITA targeting sequence
ccuggugaguuacgguagca

SEQ ID NO: 44970 - RNA, 20 nt, Artificial Sequence
  CIITA targeting sequence
ccaggggacggcagcagagc

SEQ ID NO: 44971 - RNA, 20 nt, Artificial Sequence
  CIITA targeting sequence
uccagguguaucuccuguug

SEQ ID NO: 44972 - RNA, 20 nt, Artificial Sequence
  CIITA targeting sequence
agguguaucuccuguuggug

SEQ ID NO: 44973 - RNA, 20 nt, Artificial Sequence
  CIITA targeting sequence
ccuguuggugguccacucac

SEQ ID NO: 44974 - RNA, 20 nt, Artificial Sequence
  CIITA targeting sequence
uguuggugguccacucacac

SEQ ID NO: 44975 - RNA, 20 nt, Artificial Sequence
  CIITA targeting sequence
acucacacacauaccucgcc

SEQ ID NO: 44976 - RNA, 20 nt, Artificial Sequence
  CIITA targeting sequence
cacacauaccucgccugccc

SEQ ID NO: 44977 - RNA, 20 nt, Artificial Sequence
  CIITA targeting sequence
ccugcccacuugaggucccc

SEQ ID NO: 44978 - RNA, 20 nt, Artificial Sequence
  CIITA targeting sequence
agugggcaggcgagguaugu

SEQ ID NO: 44979 - RNA, 20 nt, Artificial Sequence
  CIITA targeting sequence
ccugcucuuuuccuccugcc

SEQ ID NO: 44980 - RNA, 20 nt, Artificial Sequence
  CIITA targeting sequence
uuuccuccugcccauccaaa

SEQ ID NO: 44981 - RNA, 20 nt, Artificial Sequence
  CIITA targeting sequence
uccugcccauccaaaucccu

SEQ ID NO: 44982 - RNA, 20 nt, Artificial Sequence
  CIITA targeting sequence
ugcccauccaaaucccuagc

SEQ ID NO: 44983 - RNA, 20 nt, Artificial Sequence
  CIITA targeting sequence
aaaucccuagcucuaucccg

SEQ ID NO: 44984 - RNA, 20 nt, Artificial Sequence
  CIITA targeting sequence
cuagcucuaucccgaaaaug

SEQ ID NO: 44985 - RNA, 20 nt, Artificial Sequence
  CIITA targeting sequence
aucccgaaaaugccaguucu

SEQ ID NO: 44986 - RNA, 20 nt, Artificial Sequence
  CIITA targeting sequence
cgaaaaugccaguucuuccc

SEQ ID NO: 44987 - RNA, 20 nt, Artificial Sequence
  CIITA targeting sequence
ggauagagcuagggauuugg

SEQ ID NO: 44988 - RNA, 20 nt, Artificial Sequence
  CIITA targeting sequence
ucccuaaaaauugcccuggu

SEQ ID NO: 44989 - RNA, 20 nt, Artificial Sequence
  CIITA targeting sequence
cuaaaaauugcccuggugac

SEQ ID NO: 44990 - RNA, 20 nt, Artificial Sequence
  CIITA targeting sequence
ccagggcaauuuuuagggaa

SEQ ID NO: 44991 - RNA, 20 nt, Artificial Sequence
  CIITA targeting sequence
gccaacaagaguuuugcugu

SEQ ID NO: 44992 - RNA, 20 nt, Artificial Sequence
  CIITA targeting sequence
uguuggcugaagucaccagg

SEQ ID NO: 44993 - RNA, 20 nt, Artificial Sequence
  CIITA targeting sequence
ucucuaacuucuucugugcc

SEQ ID NO: 44994 - RNA, 20 nt, Artificial Sequence
  CIITA targeting sequence
cuaacuucuucugugccugu

SEQ ID NO: 44995 - RNA, 20 nt, Artificial Sequence
  CIITA targeting sequence
aacuucuucugugccuguuc

SEQ ID NO: 44996 - RNA, 20 nt, Artificial Sequence
  CIITA targeting sequence
ucugugccuguucacacugu

SEQ ID NO: 44997 - RNA, 20 nt, Artificial Sequence
  CIITA targeting sequence
gugccuguucacacuguccc

SEQ ID NO: 44998 - RNA, 20 nt, Artificial Sequence
  CIITA targeting sequence
cacugucccacacaguuaac

SEQ ID NO: 44999 - RNA, 20 nt, Artificial Sequence
  CIITA targeting sequence
cacacaguuaacacauuauu

SEQ ID NO: 45000 - RNA, 20 nt, Artificial Sequence
  CIITA targeting sequence
caucgccaaagagugggucg

SEQ ID NO: 45001 - RNA, 20 nt, Artificial Sequence
  CIITA targeting sequence
ucgccaaagagugggucggc

SEQ ID NO: 45002 - RNA, 20 nt, Artificial Sequence
  CIITA targeting sequence
ccaaagagugggucggcugu

SEQ ID NO: 45003 - RNA, 20 nt, Artificial Sequence
  CIITA targeting sequence
uuggcgaugagaaguauaua

SEQ ID NO: 45004 - RNA, 20 nt, Artificial Sequence
  CIITA targeting sequence
gcuguuagcuccugugcguu

SEQ ID NO: 45005 - RNA, 20 nt, Artificial Sequence
  CIITA targeting sequence
ugugcguucuuaaaguuuca

SEQ ID NO: 45006 - RNA, 20 nt, Artificial Sequence
  CIITA targeting sequence
uaaaguuucaucucggccuu

SEQ ID NO: 45007 - RNA, 20 nt, Artificial Sequence
  CIITA targeting sequence
ucucggccuugaguuagacc

SEQ ID NO: 45008 - RNA, 20 nt, Artificial Sequence
  CIITA targeting sequence
cggccuugaguuagacccuc

SEQ ID NO: 45009 - RNA, 20 nt, Artificial Sequence
  CIITA targeting sequence
gccuugaguuagacccucag

SEQ ID NO: 45010 - RNA, 20 nt, Artificial Sequence
  CIITA targeting sequence
aggccgagaugaaacuuuaa

SEQ ID NO: 45011 - RNA, 20 nt, Artificial Sequence
  CIITA targeting sequence
aacucaaggccgagaugaaa

SEQ ID NO: 45012 - RNA, 20 nt, Artificial Sequence
  CIITA targeting sequence
ggaagcuggccgggguuccu

SEQ ID NO: 45013 - RNA, 20 nt, Artificial Sequence
  CIITA targeting sequence
ugagggucuaacucaaggcc

SEQ ID NO: 45014 - RNA, 20 nt, Artificial Sequence
  CIITA targeting sequence
uguccuuuggcuaucagaca

SEQ ID NO: 45015 - RNA, 20 nt, Artificial Sequence
  CIITA targeting sequence
uuuggcuaucagacauuguc

SEQ ID NO: 45016 - RNA, 20 nt, Artificial Sequence
  CIITA targeting sequence
gacauugucuuccuuuguua

SEQ ID NO: 45017 - RNA, 20 nt, Artificial Sequence
  CIITA targeting sequence
gauagccaaaggacaggaac

SEQ ID NO: 45018 - RNA, 20 nt, Artificial Sequence
  CIITA targeting sequence
uccuuuguuacauaucuuuu

SEQ ID NO: 45019 - RNA, 20 nt, Artificial Sequence
  CIITA targeting sequence
uuuguuacauaucuuuuuug

SEQ ID NO: 45020 - RNA, 20 nt, Artificial Sequence
  CIITA targeting sequence
uuuuuguuguuuucucccaa

SEQ ID NO: 45021 - RNA, 20 nt, Artificial Sequence
  CIITA targeting sequence
cccaauuugaacauaagaau

SEQ ID NO: 45022 - RNA, 20 nt, Artificial Sequence
  CIITA targeting sequence
caauuugaacauaagaauca

SEQ ID NO: 45023 - RNA, 20 nt, Artificial Sequence
  CIITA targeting sequence
aauugggagaaaacaacaaa

SEQ ID NO: 45024 - RNA, 20 nt, Artificial Sequence
  CIITA targeting sequence
uauguucaaauugggagaaa

SEQ ID NO: 45025 - RNA, 20 nt, Artificial Sequence
  CIITA targeting sequence
ugaaagccuguauggcuugu

SEQ ID NO: 45026 - RNA, 20 nt, Artificial Sequence
  CIITA targeting sequence
ugauucuuauguucaaauug

SEQ ID NO: 45027 - RNA, 20 nt, Artificial Sequence
  CIITA targeting sequence
gcuggguacugguaugccag

SEQ ID NO: 45028 - RNA, 20 nt, Artificial Sequence
  CIITA targeting sequence
ugugcuggcauaccaguacc

SEQ ID NO: 45029 - RNA, 20 nt, Artificial Sequence
  CIITA targeting sequence
gccacguccugugcuggcau

SEQ ID NO: 45030 - RNA, 20 nt, Artificial Sequence
  CIITA targeting sequence
acaaauauuugucacaggau

SEQ ID NO: 45031 - RNA, 20 nt, Artificial Sequence
  CIITA targeting sequence
caggaugaacgagaggcaga

SEQ ID NO: 45032 - RNA, 20 nt, Artificial Sequence
  CIITA targeting sequence
ugugacaaauauuuguugau

SEQ ID NO: 45033 - RNA, 20 nt, Artificial Sequence
  CIITA targeting sequence
uccugugacaaauauuuguu

SEQ ID NO: 45034 - RNA, 20 nt, Artificial Sequence
  CIITA targeting sequence
uucauccugugacaaauauu

SEQ ID NO: 45035 - RNA, 20 nt, Artificial Sequence
  CIITA targeting sequence
cguucauccugugacaaaua

SEQ ID NO: 45036 - RNA, 20 nt, Artificial Sequence
  CIITA targeting sequence
gccucucguucauccuguga

SEQ ID NO: 45037 - RNA, 20 nt, Artificial Sequence
  CIITA targeting sequence
guuuucagaaaaggccaguc

SEQ ID NO: 45038 - RNA, 20 nt, Artificial Sequence
  CIITA targeting sequence
gaaaaggccagucuuuuccc

SEQ ID NO: 45039 - RNA, 20 nt, Artificial Sequence
  CIITA targeting sequence
gaaaacagaggucugccucu

SEQ ID NO: 45040 - RNA, 20 nt, Artificial Sequence
  CIITA targeting sequence
uuucccaacaacugcuuguu

SEQ ID NO: 45041 - RNA, 20 nt, Artificial Sequence
  CIITA targeting sequence
caacaacugcuuguucuccc

SEQ ID NO: 45042 - RNA, 20 nt, Artificial Sequence
  CIITA targeting sequence
ccccaguuuagucacagcac

SEQ ID NO: 45043 - RNA, 20 nt, Artificial Sequence
  CIITA targeting sequence
ccaguuuagucacagcaccu

SEQ ID NO: 45044 - RNA, 20 nt, Artificial Sequence
  CIITA targeting sequence
cagcaccugugccacagcca

SEQ ID NO: 45045 - RNA, 20 nt, Artificial Sequence
  CIITA targeting sequence
uggcuguggcacaggugcug

SEQ ID NO: 45046 - RNA, 20 nt, Artificial Sequence
  CIITA targeting sequence
cuagggcuaaagcccuaaag

SEQ ID NO: 45047 - RNA, 20 nt, Artificial Sequence
  CIITA targeting sequence
agggcuaaagcccuaaagaa

SEQ ID NO: 45048 - RNA, 20 nt, Artificial Sequence
  CIITA targeting sequence
uuagggcuuuagcccuagag

SEQ ID NO: 45049 - RNA, 20 nt, Artificial Sequence
  CIITA targeting sequence
ccggcccagccucacuugcc

SEQ ID NO: 45050 - RNA, 20 nt, Artificial Sequence
  CIITA targeting sequence
cuugccggcccuguuugaca

SEQ ID NO: 45051 - RNA, 20 nt, Artificial Sequence
  CIITA targeting sequence
aacagggccggcaagugagg

SEQ ID NO: 45052 - RNA, 20 nt, Artificial Sequence
  CIITA targeting sequence
uugggggaugauucaccagg

SEQ ID NO: 45053 - RNA, 20 nt, Artificial Sequence
  CIITA targeting sequence
cccaaagaugucaaacaggg

SEQ ID NO: 45054 - RNA, 20 nt, Artificial Sequence
  CIITA targeting sequence
ucccccaaagaugucaaaca

SEQ ID NO: 45055 - RNA, 20 nt, Artificial Sequence
  CIITA targeting sequence
ccaggggaagcacagccugu

SEQ ID NO: 45056 - RNA, 20 nt, Artificial Sequence
  CIITA targeting sequence
ccuggugaaucaucccccaa

SEQ ID NO: 45057 - RNA, 20 nt, Artificial Sequence
  CIITA targeting sequence
caggcugugcuuccccuggu

SEQ ID NO: 45058 - RNA, 20 nt, Artificial Sequence
  CIITA targeting sequence
cuaauccucuagccugauuc

SEQ ID NO: 45059 - RNA, 20 nt, Artificial Sequence
  CIITA targeting sequence
aauccucuagccugauucca

SEQ ID NO: 45060 - RNA, 20 nt, Artificial Sequence
  CIITA targeting sequence
ucuagccugauuccacccuc

SEQ ID NO: 45061 - RNA, 20 nt, Artificial Sequence
  CIITA targeting sequence
agccugauuccacccuccgu

SEQ ID NO: 45062 - RNA, 20 nt, Artificial Sequence
  CIITA targeting sequence
ggcuagaggauuagagaagg

SEQ ID NO: 45063 - RNA, 20 nt, Artificial Sequence
  CIITA targeting sequence
acccuccgugaagcuucucc

SEQ ID NO: 45064 - RNA, 20 nt, Artificial Sequence
  CIITA targeting sequence
gugaagcuucuccuuguccu

SEQ ID NO: 45065 - RNA, 20 nt, Artificial Sequence
  CIITA targeting sequence
cggaggguggaaucaggcua

SEQ ID NO: 45066 - RNA, 20 nt, Artificial Sequence
  CIITA targeting sequence
ccuuguccugcuggccagaa

SEQ ID NO: 45067 - RNA, 20 nt, Artificial Sequence
  CIITA targeting sequence
uuguccugcuggccagaagg

SEQ ID NO: 45068 - RNA, 20 nt, Artificial Sequence
  CIITA targeting sequence
ugcuggccagaaggcugaac

SEQ ID NO: 45069 - RNA, 20 nt, Artificial Sequence
  CIITA targeting sequence
ggccagcaggacaaggagaa

SEQ ID NO: 45070 - RNA, 20 nt, Artificial Sequence
  CIITA targeting sequence
gccuucuggccagcaggaca

SEQ ID NO: 45071 - RNA, 20 nt, Artificial Sequence
  CIITA targeting sequence
guguucagccuucuggccag

SEQ ID NO: 45072 - RNA, 20 nt, Artificial Sequence
  CIITA targeting sequence
ggucaguguucagccuucug

SEQ ID NO: 45073 - RNA, 20 nt, Artificial Sequence
  CIITA targeting sequence
gggcacagagugggacacac

SEQ ID NO: 45074 - RNA, 20 nt, Artificial Sequence
  CIITA targeting sequence
gugcccugaaaaccaccauc

SEQ ID NO: 45075 - RNA, 20 nt, Artificial Sequence
  CIITA targeting sequence
cacucugugcccugaaaacc

SEQ ID NO: 45076 - RNA, 20 nt, Artificial Sequence
  CIITA targeting sequence
ccagugugucccacucugug

SEQ ID NO: 45077 - RNA, 20 nt, Artificial Sequence
  CIITA targeting sequence
gcagggccucugcccgagug

SEQ ID NO: 45078 - RNA, 20 nt, Artificial Sequence
  CIITA targeting sequence
gcccgagugcugaacaggcc

SEQ ID NO: 45079 - RNA, 20 nt, Artificial Sequence
  CIITA targeting sequence
ggcagaggcccugcagacgu

SEQ ID NO: 45080 - RNA, 20 nt, Artificial Sequence
  CIITA targeting sequence
gcacucgggcagaggcccug

SEQ ID NO: 45081 - RNA, 20 nt, Artificial Sequence
  CIITA targeting sequence
ggccuguucagcacucgggc

SEQ ID NO: 45082 - RNA, 20 nt, Artificial Sequence
  CIITA targeting sequence
gucuggccuguucagcacuc

SEQ ID NO: 45083 - RNA, 20 nt, Artificial Sequence
  CIITA targeting sequence
gugucucccaucccucuacc

SEQ ID NO: 45084 - RNA, 20 nt, Artificial Sequence
  CIITA targeting sequence
cccaucccucuaccacaccu

SEQ ID NO: 45085 - RNA, 20 nt, Artificial Sequence
  CIITA targeting sequence
caucccucuaccacaccuga

SEQ ID NO: 45086 - RNA, 20 nt, Artificial Sequence
  CIITA targeting sequence
cucuaccacaccugagacau

SEQ ID NO: 45087 - RNA, 20 nt, Artificial Sequence
  CIITA targeting sequence
accacaccugagacauuguu

SEQ ID NO: 45088 - RNA, 20 nt, Artificial Sequence
  CIITA targeting sequence
ggugugguagagggauggga

SEQ ID NO: 45089 - RNA, 20 nt, Artificial Sequence
  CIITA targeting sequence
caggugugguagagggaugg

SEQ ID NO: 45090 - RNA, 20 nt, Artificial Sequence
  CIITA targeting sequence
aaauaacaaugucucaggug

SEQ ID NO: 45091 - RNA, 20 nt, Artificial Sequence
  CIITA targeting sequence
acacagcuccaaauaacaau

SEQ ID NO: 45092 - RNA, 20 nt, Artificial Sequence
  CIITA targeting sequence
aacccccagaccuccuauca

SEQ ID NO: 45093 - RNA, 20 nt, Artificial Sequence
  CIITA targeting sequence
ggggguuagaaauuuacccc

SEQ ID NO: 45094 - RNA, 20 nt, Artificial Sequence
  CIITA targeting sequence
uaucauucugcuuauccuuu

SEQ ID NO: 45095 - RNA, 20 nt, Artificial Sequence
  CIITA targeting sequence
uucugcuuauccuuucucau

SEQ ID NO: 45096 - RNA, 20 nt, Artificial Sequence
  CIITA targeting sequence
gcuuauccuuucucaugccc

SEQ ID NO: 45097 - RNA, 20 nt, Artificial Sequence
  CIITA targeting sequence
uuucucaugccccaccuugc

SEQ ID NO: 45098 - RNA, 20 nt, Artificial Sequence
  CIITA targeting sequence
caugccccaccuugcaaaug

SEQ ID NO: 45099 - RNA, 20 nt, Artificial Sequence
  CIITA targeting sequence
ugccccaccuugcaaaugua

SEQ ID NO: 45100 - RNA, 20 nt, Artificial Sequence
  CIITA targeting sequence
aaaucuugaaggaggagcau

SEQ ID NO: 45101 - RNA, 20 nt, Artificial Sequence
  CIITA targeting sequence
ugaaggaggagcauccuaau

SEQ ID NO: 45102 - RNA, 20 nt, Artificial Sequence
  CIITA targeting sequence
agauuuugaaauguacauuu

SEQ ID NO: 45103 - RNA, 20 nt, Artificial Sequence
  CIITA targeting sequence
uucaagauuuugaaauguac

SEQ ID NO: 45104 - RNA, 20 nt, Artificial Sequence
  CIITA targeting sequence
uccuucaagauuuugaaaug

SEQ ID NO: 45105 - RNA, 20 nt, Artificial Sequence
  CIITA targeting sequence
uaauaagcucauuauggugc

SEQ ID NO: 45106 - RNA, 20 nt, Artificial Sequence
  CIITA targeting sequence
uuauggugcaaggcauagca

SEQ ID NO: 45107 - RNA, 20 nt, Artificial Sequence
  CIITA targeting sequence
gcacgugcuaugccuugcac

SEQ ID NO: 45108 - RNA, 20 nt, Artificial Sequence
  CIITA targeting sequence
cugaaaugaacuuggaccua

SEQ ID NO: 45109 - RNA, 20 nt, Artificial Sequence
  CIITA targeting sequence
gugacagcauuuucugcacg

SEQ ID NO: 45110 - RNA, 20 nt, Artificial Sequence
  CIITA targeting sequence
uuucagugacagcauuuucu

SEQ ID NO: 45111 - RNA, 20 nt, Artificial Sequence
  CIITA targeting sequence
aaguucauuucagugacagc

SEQ ID NO: 45112 - RNA, 20 nt, Artificial Sequence
  CIITA targeting sequence
ugucucugaaauggacugaa

SEQ ID NO: 45113 - RNA, 20 nt, Artificial Sequence
  CIITA targeting sequence
cugaaauggacugaauugcu

SEQ ID NO: 45114 - RNA, 20 nt, Artificial Sequence
  CIITA targeting sequence
gaaauggacugaauugcuaa

SEQ ID NO: 45115 - RNA, 20 nt, Artificial Sequence
  CIITA targeting sequence
gagacaggaauacuaggucc

SEQ ID NO: 45116 - RNA, 20 nt, Artificial Sequence
  CIITA targeting sequence
auuucagagacaggaauacu

SEQ ID NO: 45117 - RNA, 20 nt, Artificial Sequence
  CIITA targeting sequence
guccauuucagagacaggaa

SEQ ID NO: 45118 - RNA, 20 nt, Artificial Sequence
  CIITA targeting sequence
aaaauuagcaauucagucca

SEQ ID NO: 45119 - RNA, 20 nt, Artificial Sequence
  CIITA targeting sequence
uucaaaaauuagcaauucag

SEQ ID NO: 45120 - RNA, 20 nt, Artificial Sequence
  CIITA targeting sequence
cagguuaaaccacuacaguu

SEQ ID NO: 45121 - RNA, 20 nt, Artificial Sequence
  CIITA targeting sequence
cuaauuucacagguuaaacc

SEQ ID NO: 45122 - RNA, 20 nt, Artificial Sequence
  CIITA targeting sequence
ugagaaagcagaggcuauug

SEQ ID NO: 45123 - RNA, 20 nt, Artificial Sequence
  CIITA targeting sequence
agagucacuaauuucacagg

SEQ ID NO: 45124 - RNA, 20 nt, Artificial Sequence
  CIITA targeting sequence
caagagucacuaauuucaca

SEQ ID NO: 45125 - RNA, 20 nt, Artificial Sequence
  CIITA targeting sequence
gcuuucucaagagucacuaa

SEQ ID NO: 45126 - RNA, 20 nt, Artificial Sequence
  CIITA targeting sequence
auagccucugcuuucucaag

SEQ ID NO: 45127 - RNA, 20 nt, Artificial Sequence
  CIITA targeting sequence
ggccucaauagccucugcuu

SEQ ID NO: 45128 - RNA, 20 nt, Artificial Sequence
  CIITA targeting sequence
gucauccuuggugaugcacc

SEQ ID NO: 45129 - RNA, 20 nt, Artificial Sequence
  CIITA targeting sequence
uccuuggugaugcaccucga

SEQ ID NO: 45130 - RNA, 20 nt, Artificial Sequence
  CIITA targeting sequence
uuggugaugcaccucgagug

SEQ ID NO: 45131 - RNA, 20 nt, Artificial Sequence
  CIITA targeting sequence
ccaaggaugacagacguaaa

SEQ ID NO: 45132 - RNA, 20 nt, Artificial Sequence
  CIITA targeting sequence
aguguguugguuacaguuuc

SEQ ID NO: 45133 - RNA, 20 nt, Artificial Sequence
  CIITA targeting sequence
aggugcaucaccaaggauga

SEQ ID NO: 45134 - RNA, 20 nt, Artificial Sequence
  CIITA targeting sequence
cuucuccaggcauuucaaac

SEQ ID NO: 45135 - RNA, 20 nt, Artificial Sequence
  CIITA targeting sequence
ucuccaggcauuucaaacuc

SEQ ID NO: 45136 - RNA, 20 nt, Artificial Sequence
  CIITA targeting sequence
ccaggcauuucaaacucuga

SEQ ID NO: 45137 - RNA, 20 nt, Artificial Sequence
  CIITA targeting sequence
aggcauuucaaacucugaag

SEQ ID NO: 45138 - RNA, 20 nt, Artificial Sequence
  CIITA targeting sequence
aacucugaagcucaucuguc

SEQ ID NO: 45139 - RNA, 20 nt, Artificial Sequence
  CIITA targeting sequence
gaagcucaucugucggugga

SEQ ID NO: 45140 - RNA, 20 nt, Artificial Sequence
  CIITA targeting sequence
gaguuugaaaugccuggaga

SEQ ID NO: 45141 - RNA, 20 nt, Artificial Sequence
  CIITA targeting sequence
ucugucgguggagaguuagc

SEQ ID NO: 45142 - RNA, 20 nt, Artificial Sequence
  CIITA targeting sequence
gucgguggagaguuagcuaa

SEQ ID NO: 45143 - RNA, 20 nt, Artificial Sequence
  CIITA targeting sequence
guggagaguuagcuaacagg

SEQ ID NO: 45144 - RNA, 20 nt, Artificial Sequence
  CIITA targeting sequence
accgacagaugagcuucaga

SEQ ID NO: 45145 - RNA, 20 nt, Artificial Sequence
  CIITA targeting sequence
ccaccgacagaugagcuuca

SEQ ID NO: 45146 - RNA, 20 nt, Artificial Sequence
  CIITA targeting sequence
gauauugagacugcaucugc

SEQ ID NO: 45147 - RNA, 20 nt, Artificial Sequence
  CIITA targeting sequence
gagcuuugccuguuagcuaa

SEQ ID NO: 45148 - RNA, 20 nt, Artificial Sequence
  CIITA targeting sequence
auauccgagcuuugccuguu

SEQ ID NO: 45149 - RNA, 20 nt, Artificial Sequence
  CIITA targeting sequence
caauauccgagcuuugccug

SEQ ID NO: 45150 - RNA, 20 nt, Artificial Sequence
  CIITA targeting sequence
gcagagcuccugcuggggau

SEQ ID NO: 45151 - RNA, 20 nt, Artificial Sequence
  CIITA targeting sequence
gcagaugcagucucaauauc

SEQ ID NO: 45152 - RNA, 20 nt, Artificial Sequence
  CIITA targeting sequence
ugcuggggauaugagaauac

SEQ ID NO: 45153 - RNA, 20 nt, Artificial Sequence
  CIITA targeting sequence
ccagcaggagcucugcagau

SEQ ID NO: 45154 - RNA, 20 nt, Artificial Sequence
  CIITA targeting sequence
uauccccagcaggagcucug

SEQ ID NO: 45155 - RNA, 20 nt, Artificial Sequence
  CIITA targeting sequence
cauauccccagcaggagcuc

SEQ ID NO: 45156 - RNA, 20 nt, Artificial Sequence
  CIITA targeting sequence
uuuccagacaaaugggaguu

SEQ ID NO: 45157 - RNA, 20 nt, Artificial Sequence
  CIITA targeting sequence
agacaaaugggaguuagagc

SEQ ID NO: 45158 - RNA, 20 nt, Artificial Sequence
  CIITA targeting sequence
ggaaaagagccaguauucuc

SEQ ID NO: 45159 - RNA, 20 nt, Artificial Sequence
  CIITA targeting sequence
cauuugucuggaaaagagcc

SEQ ID NO: 45160 - RNA, 20 nt, Artificial Sequence
  CIITA targeting sequence
aacucccauuugucuggaaa

SEQ ID NO: 45161 - RNA, 20 nt, Artificial Sequence
  CIITA targeting sequence
uuauaaaaggcucuaacucc

SEQ ID NO: 45162 - RNA, 20 nt, Artificial Sequence
  CIITA targeting sequence
auaagaucugauaguauuuu

SEQ ID NO: 45163 - RNA, 20 nt, Artificial Sequence
  CIITA targeting sequence
uauggaaaguccuuauaaaa

SEQ ID NO: 45164 - RNA, 20 nt, Artificial Sequence
  CIITA targeting sequence
gauaguauuuucaugccuuu

SEQ ID NO: 45165 - RNA, 20 nt, Artificial Sequence
  CIITA targeting sequence
gaucuuauggaaaguccuua

SEQ ID NO: 45166 - RNA, 20 nt, Artificial Sequence
  CIITA targeting sequence
ugccuuuuugguuuaucuau

SEQ ID NO: 45167 - RNA, 20 nt, Artificial Sequence
  CIITA targeting sequence
auuugguguuuuuuuaauuu

SEQ ID NO: 45168 - RNA, 20 nt, Artificial Sequence
  CIITA targeting sequence
uaaccucauguaaauucuug

SEQ ID NO: 45169 - RNA, 20 nt, Artificial Sequence
  CIITA targeting sequence
uguaaauucuuggccaauaa

SEQ ID NO: 45170 - RNA, 20 nt, Artificial Sequence
  CIITA targeting sequence
uggccaauaaaauuguugcu

SEQ ID NO: 45171 - RNA, 20 nt, Artificial Sequence
  CIITA targeting sequence
uuguuugcauuucuguaguc

SEQ ID NO: 45172 - RNA, 20 nt, Artificial Sequence
  CIITA targeting sequence
guaguccuagaaggguugua

SEQ ID NO: 45173 - RNA, 20 nt, Artificial Sequence
  CIITA targeting sequence
uagaaggguuguaaucaugg

SEQ ID NO: 45174 - RNA, 20 nt, Artificial Sequence
  CIITA targeting sequence
aggacuacagaaaugcaaac

SEQ ID NO: 45175 - RNA, 20 nt, Artificial Sequence
  CIITA targeting sequence
uggggucuggaguucagucu

SEQ ID NO: 45176 - RNA, 20 nt, Artificial Sequence
  CIITA targeting sequence
ggaguucagucugccugguu

SEQ ID NO: 45177 - RNA, 20 nt, Artificial Sequence
  CIITA targeting sequence
agaccccaugauuacaaccc

SEQ ID NO: 45178 - RNA, 20 nt, Artificial Sequence
  CIITA targeting sequence
gucugccugguuguaaccua

SEQ ID NO: 45179 - RNA, 20 nt, Artificial Sequence
  CIITA targeting sequence
gccugguuguaaccuaggca

SEQ ID NO: 45180 - RNA, 20 nt, Artificial Sequence
  CIITA targeting sequence
ugugcugcaccagggcccug

SEQ ID NO: 45181 - RNA, 20 nt, Artificial Sequence
  CIITA targeting sequence
gcccagggcccuggugcagc

SEQ ID NO: 45182 - RNA, 20 nt, Artificial Sequence
  CIITA targeting sequence
gcucccagagcaucaucccc

SEQ ID NO: 45183 - RNA, 20 nt, Artificial Sequence
  CIITA targeting sequence
cagagcaucauccccaaagg

SEQ ID NO: 45184 - RNA, 20 nt, Artificial Sequence
  CIITA targeting sequence
gggagcugaggcaucugccc

SEQ ID NO: 45185 - RNA, 20 nt, Artificial Sequence
  CIITA targeting sequence
uccccaaagggucgauuguu

SEQ ID NO: 45186 - RNA, 20 nt, Artificial Sequence
  CIITA targeting sequence
ccaaagggucgauuguuucu

SEQ ID NO: 45187 - RNA, 20 nt, Artificial Sequence
  CIITA targeting sequence
auuguuucugggauuaaacg

SEQ ID NO: 45188 - RNA, 20 nt, Artificial Sequence
  CIITA targeting sequence
acccuuuggggaugaugcuc

SEQ ID NO: 45189 - RNA, 20 nt, Artificial Sequence
  CIITA targeting sequence
gggauuaaacgaagcacuca

SEQ ID NO: 45190 - RNA, 20 nt, Artificial Sequence
  CIITA targeting sequence
cagaaacaaucgacccuuug

SEQ ID NO: 45191 - RNA, 20 nt, Artificial Sequence
  CIITA targeting sequence
uuuaaucccagaaacaaucg

SEQ ID NO: 45192 - RNA, 20 nt, Artificial Sequence
  CIITA targeting sequence
gacagagacuggcaguaaua

SEQ ID NO: 45193 - RNA, 20 nt, Artificial Sequence
  CIITA targeting sequence
gagugcuucguuuaauccca

SEQ ID NO: 45194 - RNA, 20 nt, Artificial Sequence
  CIITA targeting sequence
gucugagugcuucguuuaau

SEQ ID NO: 45195 - RNA, 20 nt, Artificial Sequence
  CIITA targeting sequence
cugucugagugcuucguuua

SEQ ID NO: 45196 - RNA, 20 nt, Artificial Sequence
  CIITA targeting sequence
uauuacugccagucucuguc

SEQ ID NO: 45197 - RNA, 20 nt, Artificial Sequence
  CIITA targeting sequence
ucuguuuuacugagguacau

SEQ ID NO: 45198 - RNA, 20 nt, Artificial Sequence
  CIITA targeting sequence
guuuuacugagguacauaca

SEQ ID NO: 45199 - RNA, 20 nt, Artificial Sequence
  CIITA targeting sequence
guaaaacagaugaagcuucc

SEQ ID NO: 45200 - RNA, 20 nt, Artificial Sequence
  CIITA targeting sequence
aacuauguauguaccucagu

SEQ ID NO: 45201 - RNA, 20 nt, Artificial Sequence
  CIITA targeting sequence
caaacuauguauguaccuca

SEQ ID NO: 45202 - RNA, 20 nt, Artificial Sequence
  CIITA targeting sequence
uucuaacagugguuaucauu

SEQ ID NO: 45203 - RNA, 20 nt, Artificial Sequence
  CIITA targeting sequence
aacagugguuaucauuguaa

SEQ ID NO: 45204 - RNA, 20 nt, Artificial Sequence
  CIITA targeting sequence
uuguaagagaaacauuuuaa

SEQ ID NO: 45205 - RNA, 20 nt, Artificial Sequence
  CIITA targeting sequence
uacaaugauaaccacuguua

SEQ ID NO: 45206 - RNA, 20 nt, Artificial Sequence
  CIITA targeting sequence
cuuacaaugauaaccacugu

SEQ ID NO: 45207 - RNA, 20 nt, Artificial Sequence
  CIITA targeting sequence
guccuuugaaacuuuucuga

SEQ ID NO: 45208 - RNA, 20 nt, Artificial Sequence
  CIITA targeting sequence
uuugaaacuuuucugagaua

SEQ ID NO: 45209 - RNA, 20 nt, Artificial Sequence
  CIITA targeting sequence
aaggacagaauaauuaccuu

SEQ ID NO: 45210 - RNA, 20 nt, Artificial Sequence
  CIITA targeting sequence
gagauaaagacacagcuuuc

SEQ ID NO: 45211 - RNA, 20 nt, Artificial Sequence
  CIITA targeting sequence
gaaaaguuucaaaggacaga

SEQ ID NO: 45212 - RNA, 20 nt, Artificial Sequence
  CIITA targeting sequence
cagaaaaguuucaaaggaca

SEQ ID NO: 45213 - RNA, 20 nt, Artificial Sequence
  CIITA targeting sequence
uuaucucagaaaaguuucaa

SEQ ID NO: 45214 - RNA, 20 nt, Artificial Sequence
  CIITA targeting sequence
auacaaagauggucauagca

SEQ ID NO: 45215 - RNA, 20 nt, Artificial Sequence
  CIITA targeting sequence
uuguauggaaagcugugucu

SEQ ID NO: 45216 - RNA, 20 nt, Artificial Sequence
  CIITA targeting sequence
uagcaacauuguuaucacuc

SEQ ID NO: 45217 - RNA, 20 nt, Artificial Sequence
  CIITA targeting sequence
cucacacaauuaggaaucuu

SEQ ID NO: 45218 - RNA, 20 nt, Artificial Sequence
  CIITA targeting sequence
cacaauuaggaaucuuaaug

SEQ ID NO: 45219 - RNA, 20 nt, Artificial Sequence
  CIITA targeting sequence
uaauugugugagugauaaca

SEQ ID NO: 45220 - RNA, 20 nt, Artificial Sequence
  CIITA targeting sequence
uaaugcccuucaaaagaguu

SEQ ID NO: 45221 - RNA, 20 nt, Artificial Sequence
  CIITA targeting sequence
aaagaguugcuacugugcuu

SEQ ID NO: 45222 - RNA, 20 nt, Artificial Sequence
  CIITA targeting sequence
uuugaagggcauuaagauuc

SEQ ID NO: 45223 - RNA, 20 nt, Artificial Sequence
  CIITA targeting sequence
uuucagugucauacugugua

SEQ ID NO: 45224 - RNA, 20 nt, Artificial Sequence
  CIITA targeting sequence
gugucauacuguguagccau

SEQ ID NO: 45225 - RNA, 20 nt, Artificial Sequence
  CIITA targeting sequence
uacuguguagccauuacaga

SEQ ID NO: 45226 - RNA, 20 nt, Artificial Sequence
  CIITA targeting sequence
guaauggcuacacaguauga

SEQ ID NO: 45227 - RNA, 20 nt, Artificial Sequence
  CIITA targeting sequence
auaaccaaaaaaagugcuuu

SEQ ID NO: 45228 - RNA, 20 nt, Artificial Sequence
  CIITA targeting sequence
gcuaaaacaaaagcacuuuu

SEQ ID NO: 45229 - RNA, 20 nt, Artificial Sequence
  CIITA targeting sequence
caccucagcuaaaacaaaag

SEQ ID NO: 45230 - RNA, 20 nt, Artificial Sequence
  CIITA targeting sequence
uauuucccaccucagcuaaa

SEQ ID NO: 45231 - RNA, 20 nt, Artificial Sequence
  CIITA targeting sequence
gugccaaucuuauuucccac

SEQ ID NO: 45232 - RNA, 20 nt, Artificial Sequence
  CIITA targeting sequence
auuucagugccaaucuuauu

SEQ ID NO: 45233 - RNA, 20 nt, Artificial Sequence
  CIITA targeting sequence
uguugcauuauccauuucag

SEQ ID NO: 45234 - RNA, 20 nt, Artificial Sequence
  CIITA targeting sequence
acuauguaaauauccauagc

SEQ ID NO: 45235 - RNA, 20 nt, Artificial Sequence
  CIITA targeting sequence
auagcaaagaaaaagacccg

SEQ ID NO: 45236 - RNA, 20 nt, Artificial Sequence
  CIITA targeting sequence
uugcuauggauauuuacaua

SEQ ID NO: 45237 - RNA, 20 nt, Artificial Sequence
  CIITA targeting sequence
uuuucuuugcuauggauauu

SEQ ID NO: 45238 - RNA, 20 nt, Artificial Sequence
  CIITA targeting sequence
ggucuuuuucuuugcuaugg

SEQ ID NO: 45239 - RNA, 20 nt, Artificial Sequence
  CIITA targeting sequence
ucgggucuuuuucuuugcua

SEQ ID NO: 45240 - RNA, 20 nt, Artificial Sequence
  CIITA targeting sequence
auuuccucgggucuuuuucu

SEQ ID NO: 45241 - RNA, 20 nt, Artificial Sequence
  CIITA targeting sequence
agcagcagucaucucuaggc

SEQ ID NO: 45242 - RNA, 20 nt, Artificial Sequence
  CIITA targeting sequence
ucucuaggcaccacgguugc

SEQ ID NO: 45243 - RNA, 20 nt, Artificial Sequence
  CIITA targeting sequence
cuaggcaccacgguugccgu

SEQ ID NO: 45244 - RNA, 20 nt, Artificial Sequence
  CIITA targeting sequence
aggcaccacgguugccguuu

SEQ ID NO: 45245 - RNA, 20 nt, Artificial Sequence
  CIITA targeting sequence
cuuucauuguugucaaaguu

SEQ ID NO: 45246 - RNA, 20 nt, Artificial Sequence
  CIITA targeting sequence
uucauuguugucaaaguuuc

SEQ ID NO: 45247 - RNA, 20 nt, Artificial Sequence
  CIITA targeting sequence
uuguugucaaaguuuccuac

SEQ ID NO: 45248 - RNA, 20 nt, Artificial Sequence
  CIITA targeting sequence
aaguuuccuacuucucuaaa

SEQ ID NO: 45249 - RNA, 20 nt, Artificial Sequence
  CIITA targeting sequence
uacuucucuaaagugaaugu

SEQ ID NO: 45250 - RNA, 20 nt, Artificial Sequence
  CIITA targeting sequence
cuaaagugaauguuacauuu

SEQ ID NO: 45251 - RNA, 20 nt, Artificial Sequence
  CIITA targeting sequence
aaagugaauguuacauuuau

SEQ ID NO: 45252 - RNA, 20 nt, Artificial Sequence
  CIITA targeting sequence
cuuuagagaaguaggaaacu

SEQ ID NO: 45253 - RNA, 20 nt, Artificial Sequence
  CIITA targeting sequence
gaagguuuuauuaaaauggg

SEQ ID NO: 45254 - RNA, 20 nt, Artificial Sequence
  CIITA targeting sequence
gauuauaaauguaacauuca

SEQ ID NO: 45255 - RNA, 20 nt, Artificial Sequence
  CIITA targeting sequence
cccggcccauuuuaauaaaa

SEQ ID NO: 45256 - RNA, 20 nt, Artificial Sequence
  CIITA targeting sequence
caccuguaaucccagcacuu

SEQ ID NO: 45257 - RNA, 20 nt, Artificial Sequence
  CIITA targeting sequence
cagcacuuugggaagccgag

SEQ ID NO: 45258 - RNA, 20 nt, Artificial Sequence
  CIITA targeting sequence
caaagugcugggauuacagg

SEQ ID NO: 45259 - RNA, 20 nt, Artificial Sequence
  CIITA targeting sequence
gcuucccaaagugcugggau

SEQ ID NO: 45260 - RNA, 20 nt, Artificial Sequence
  CIITA targeting sequence
gccugccucggcuucccaaa

SEQ ID NO: 45261 - RNA, 20 nt, Artificial Sequence
  CIITA targeting sequence
guugaggucuggaguucaag

SEQ ID NO: 45262 - RNA, 20 nt, Artificial Sequence
  CIITA targeting sequence
acugaucugccugccucggc

SEQ ID NO: 45263 - RNA, 20 nt, Artificial Sequence
  CIITA targeting sequence
ggaguucaagaccagccugg

SEQ ID NO: 45264 - RNA, 20 nt, Artificial Sequence
  CIITA targeting sequence
agaccucaacugaucugccu

SEQ ID NO: 45265 - RNA, 20 nt, Artificial Sequence
  CIITA targeting sequence
agaccagccuggccaacaug

SEQ ID NO: 45266 - RNA, 20 nt, Artificial Sequence
  CIITA targeting sequence
ugaacuccagaccucaacug

SEQ ID NO: 45267 - RNA, 20 nt, Artificial Sequence
  CIITA targeting sequence
cuacuaaaaguacaaaaauu

SEQ ID NO: 45268 - RNA, 20 nt, Artificial Sequence
  CIITA targeting sequence
acuaaaaguacaaaaauuag

SEQ ID NO: 45269 - RNA, 20 nt, Artificial Sequence
  CIITA targeting sequence
gcuaccugggaaucugaggu

SEQ ID NO: 45270 - RNA, 20 nt, Artificial Sequence
  CIITA targeting sequence
cagguagcugaguuuauagg

SEQ ID NO: 45271 - RNA, 20 nt, Artificial Sequence
  CIITA targeting sequence
gagguaggagaaucgccuga

SEQ ID NO: 45272 - RNA, 20 nt, Artificial Sequence
  CIITA targeting sequence
gauucccagguagcugaguu

SEQ ID NO: 45273 - RNA, 20 nt, Artificial Sequence
  CIITA targeting sequence
uaccucagauucccagguag

SEQ ID NO: 45274 - RNA, 20 nt, Artificial Sequence
  CIITA targeting sequence
ccuaccucagauucccaggu

SEQ ID NO: 45275 - RNA, 20 nt, Artificial Sequence
  CIITA targeting sequence
ccugaaccuaagaggcggag

SEQ ID NO: 45276 - RNA, 20 nt, Artificial Sequence
  CIITA targeting sequence
ggcgauucuccuaccucaga

SEQ ID NO: 45277 - RNA, 20 nt, Artificial Sequence
  CIITA targeting sequence
uagguucaggcgauucuccu

SEQ ID NO: 45278 - RNA, 20 nt, Artificial Sequence
  CIITA targeting sequence
gccucuuagguucaggcgau

SEQ ID NO: 45279 - RNA, 20 nt, Artificial Sequence
  CIITA targeting sequence
cugcggccuccgccucuuag

SEQ ID NO: 45280 - RNA, 20 nt, Artificial Sequence
  CIITA targeting sequence
uggcucacugcggccuccgc

SEQ ID NO: 45281 - RNA, 20 nt, Artificial Sequence
  CIITA targeting sequence
cgccacugcacuccagccug

SEQ ID NO: 45282 - RNA, 20 nt, Artificial Sequence
  CIITA targeting sequence
agccugaugacagagcaaga

SEQ ID NO: 45283 - RNA, 20 nt, Artificial Sequence
  CIITA targeting sequence
ggcuggagugcaguggcgug

SEQ ID NO: 45284 - RNA, 20 nt, Artificial Sequence
  CIITA targeting sequence
ucaggcuggagugcaguggc

SEQ ID NO: 45285 - RNA, 20 nt, Artificial Sequence
  CIITA targeting sequence
gucaucaggcuggagugcag

SEQ ID NO: 45286 - RNA, 20 nt, Artificial Sequence
  CIITA targeting sequence
ugcucugucaucaggcugga

SEQ ID NO: 45287 - RNA, 20 nt, Artificial Sequence
  CIITA targeting sequence
aucucagaaaaugacaacaa

SEQ ID NO: 45288 - RNA, 20 nt, Artificial Sequence
  CIITA targeting sequence
cagaaaaugacaacaacaac

SEQ ID NO: 45289 - RNA, 20 nt, Artificial Sequence
  CIITA targeting sequence
gaaaaugacaacaacaacaa

SEQ ID NO: 45290 - RNA, 20 nt, Artificial Sequence
  CIITA targeting sequence
gagauggagucuugcucugu

SEQ ID NO: 45291 - RNA, 20 nt, Artificial Sequence
  CIITA targeting sequence
uuuucugagauggagucuug

SEQ ID NO: 45292 - RNA, 20 nt, Artificial Sequence
  CIITA targeting sequence
cugaggugguugaauuaccu

SEQ ID NO: 45293 - RNA, 20 nt, Artificial Sequence
  CIITA targeting sequence
gaggugguugaauuaccuaa

SEQ ID NO: 45294 - RNA, 20 nt, Artificial Sequence
  CIITA targeting sequence
gagauauaaacauuuuaaua

SEQ ID NO: 45295 - RNA, 20 nt, Artificial Sequence
  CIITA targeting sequence
accaccucagagauauaaac

SEQ ID NO: 45296 - RNA, 20 nt, Artificial Sequence
  CIITA targeting sequence
uccaaagcccuggaauuaga

SEQ ID NO: 45297 - RNA, 20 nt, Artificial Sequence
  CIITA targeting sequence
aaagcccuggaauuagauac

SEQ ID NO: 45298 - RNA, 20 nt, Artificial Sequence
  CIITA targeting sequence
agggcuuuggaagauuaggu

SEQ ID NO: 45299 - RNA, 20 nt, Artificial Sequence
  CIITA targeting sequence
aauuccagggcuuuggaaga

SEQ ID NO: 45300 - RNA, 20 nt, Artificial Sequence
  CIITA targeting sequence
uaauccauucagccuuuccc

SEQ ID NO: 45301 - RNA, 20 nt, Artificial Sequence
  CIITA targeting sequence
auucagccuuuccccccauu

SEQ ID NO: 45302 - RNA, 20 nt, Artificial Sequence
  CIITA targeting sequence
gccuuuccccccauuacauu

SEQ ID NO: 45303 - RNA, 20 nt, Artificial Sequence
  CIITA targeting sequence
ccccauuacauucaagcaaa

SEQ ID NO: 45304 - RNA, 20 nt, Artificial Sequence
  CIITA targeting sequence
agcaaauguauauugagcau

SEQ ID NO: 45305 - RNA, 20 nt, Artificial Sequence
  CIITA targeting sequence
auauacauuugcuugaaugu

SEQ ID NO: 45306 - RNA, 20 nt, Artificial Sequence
  CIITA targeting sequence
cuuccuaaaacacuguguaa

SEQ ID NO: 45307 - RNA, 20 nt, Artificial Sequence
  CIITA targeting sequence
uccuaaaacacuguguaaaa

SEQ ID NO: 45308 - RNA, 20 nt, Artificial Sequence
  CIITA targeting sequence
uaaaacacuguguaaaacgg

SEQ ID NO: 45309 - RNA, 20 nt, Artificial Sequence
  CIITA targeting sequence
cacaaugcccuggcacaccg

SEQ ID NO: 45310 - RNA, 20 nt, Artificial Sequence
  CIITA targeting sequence
gucccacaaugcccuggcac

SEQ ID NO: 45311 - RNA, 20 nt, Artificial Sequence
  CIITA targeting sequence
uucugucccacaaugcccug

SEQ ID NO: 45312 - RNA, 20 nt, Artificial Sequence
  CIITA targeting sequence
ucuuucugucccacaaugcc

SEQ ID NO: 45313 - RNA, 20 nt, Artificial Sequence
  CIITA targeting sequence
ccuugcucgucuuucugucc

SEQ ID NO: 45314 - RNA, 20 nt, Artificial Sequence
  CIITA targeting sequence
uugagcuuuggagcuugcag

SEQ ID NO: 45315 - RNA, 20 nt, Artificial Sequence
  CIITA targeting sequence
augaggguuacaccuucacc

SEQ ID NO: 45316 - RNA, 20 nt, Artificial Sequence
  CIITA targeting sequence
aaagcucaaugaggguuaca

SEQ ID NO: 45317 - RNA, 20 nt, Artificial Sequence
  CIITA targeting sequence
acugaguauuucuguauacc

SEQ ID NO: 45318 - RNA, 20 nt, Artificial Sequence
  CIITA targeting sequence
guagacugcaagcuccaaag

SEQ ID NO: 45319 - RNA, 20 nt, Artificial Sequence
  CIITA targeting sequence
guauaccagcaaaagacauu

SEQ ID NO: 45320 - RNA, 20 nt, Artificial Sequence
  CIITA targeting sequence
uuugcugguauacagaaaua

SEQ ID NO: 45321 - RNA, 20 nt, Artificial Sequence
  CIITA targeting sequence
aaaugucuuuugcugguaua

SEQ ID NO: 45322 - RNA, 20 nt, Artificial Sequence
  CIITA targeting sequence
uuuucuaaaugucuuuugcu

SEQ ID NO: 45323 - RNA, 20 nt, Artificial Sequence
  CIITA targeting sequence
aauauucauuuucuaaaugu

SEQ ID NO: 45324 - RNA, 20 nt, Artificial Sequence
  CIITA targeting sequence
uuuacaauagcauaaaaaaa

SEQ ID NO: 45325 - RNA, 20 nt, Artificial Sequence
  CIITA targeting sequence
acuaccuagcagcaacucua

SEQ ID NO: 45326 - RNA, 20 nt, Artificial Sequence
  CIITA targeting sequence
acauuuuuuuaugcuauugu

SEQ ID NO: 45327 - RNA, 20 nt, Artificial Sequence
  CIITA targeting sequence
aacaauagaucugcaagauu

SEQ ID NO: 45328 - RNA, 20 nt, Artificial Sequence
  CIITA targeting sequence
auuguuagaguugcugcuag

SEQ ID NO: 45329 - RNA, 20 nt, Artificial Sequence
  CIITA targeting sequence
gcaagauuccugucaaguga

SEQ ID NO: 45330 - RNA, 20 nt, Artificial Sequence
  CIITA targeting sequence
ugcagaucuauuguuagagu

SEQ ID NO: 45331 - RNA, 20 nt, Artificial Sequence
  CIITA targeting sequence
ugucaagugagcauggaaac

SEQ ID NO: 45332 - RNA, 20 nt, Artificial Sequence
  CIITA targeting sequence
agugagcauggaaacaaaug

SEQ ID NO: 45333 - RNA, 20 nt, Artificial Sequence
  CIITA targeting sequence
cuugacaggaaucuugcaga

SEQ ID NO: 45334 - RNA, 20 nt, Artificial Sequence
  CIITA targeting sequence
augcucacuugacaggaauc

SEQ ID NO: 45335 - RNA, 20 nt, Artificial Sequence
  CIITA targeting sequence
gaauguuacacuauuguaaa

SEQ ID NO: 45336 - RNA, 20 nt, Artificial Sequence
  CIITA targeting sequence
gauauuuacagcauuuguuu

SEQ ID NO: 45337 - RNA, 20 nt, Artificial Sequence
  CIITA targeting sequence
guucucuccaaauuuagcca

SEQ ID NO: 45338 - RNA, 20 nt, Artificial Sequence
  CIITA targeting sequence
cuccaaauuuagccauagau

SEQ ID NO: 45339 - RNA, 20 nt, Artificial Sequence
  CIITA targeting sequence
ccaaauuuagccauagaugu

SEQ ID NO: 45340 - RNA, 20 nt, Artificial Sequence
  CIITA targeting sequence
aaauuuagccauagauguag

SEQ ID NO: 45341 - RNA, 20 nt, Artificial Sequence
  CIITA targeting sequence
auggcuaaauuuggagagaa

SEQ ID NO: 45342 - RNA, 20 nt, Artificial Sequence
  CIITA targeting sequence
aagaaaauuuuagcacguau

SEQ ID NO: 45343 - RNA, 20 nt, Artificial Sequence
  CIITA targeting sequence
uagacuugcccuacaucuau

SEQ ID NO: 45344 - RNA, 20 nt, Artificial Sequence
  CIITA targeting sequence
acaaaaauacgugcuaaaau

SEQ ID NO: 45345 - RNA, 20 nt, Artificial Sequence
  CIITA targeting sequence
uuuccacaaaaauacgugcu

SEQ ID NO: 45346 - RNA, 20 nt, Artificial Sequence
  CIITA targeting sequence
ucauuuccacaaaaauacgu

SEQ ID NO: 45347 - RNA, 20 nt, Artificial Sequence
  CIITA targeting sequence
ccuucuucauuuccacaaaa

SEQ ID NO: 45348 - RNA, 20 nt, Artificial Sequence
  CIITA targeting sequence
aaaaucaccuucuucauuuc

SEQ ID NO: 45349 - RNA, 20 nt, Artificial Sequence
  CIITA targeting sequence
auauacauucaaaaaucacc

SEQ ID NO: 45350 - RNA, 20 nt, Artificial Sequence
  CIITA targeting sequence
ccauauacauucaaaaauca

SEQ ID NO: 45351 - RNA, 20 nt, Artificial Sequence
  CIITA targeting sequence
uggcccuuuuaaucuccaua

SEQ ID NO: 45352 - RNA, 20 nt, Artificial Sequence
  CIITA targeting sequence
auauugccuauucuuggccc

SEQ ID NO: 45353 - RNA, 20 nt, Artificial Sequence
  CIITA targeting sequence
guuuuucaauauugccuauu

SEQ ID NO: 45354 - RNA, 20 nt, Artificial Sequence
  CIITA targeting sequence
uucuguuuuucaauauugcc

SEQ ID NO: 45355 - RNA, 20 nt, Artificial Sequence
  CIITA targeting sequence
uuccuucuguuuuucaauau

SEQ ID NO: 45356 - RNA, 20 nt, Artificial Sequence
  CIITA targeting sequence
aacuucuuuccuucuguuuu

SEQ ID NO: 45357 - RNA, 20 nt, Artificial Sequence
  CIITA targeting sequence
uccaacuucuuuccuucugu

SEQ ID NO: 45358 - RNA, 20 nt, Artificial Sequence
  CIITA targeting sequence
ugccauauaguaauuaaguc

SEQ ID NO: 45359 - RNA, 20 nt, Artificial Sequence
  CIITA targeting sequence
gacaguauggucuugauaca

SEQ ID NO: 45360 - RNA, 20 nt, Artificial Sequence
  CIITA targeting sequence
gauuacugcaguuuuacagu

SEQ ID NO: 45361 - RNA, 20 nt, Artificial Sequence
  CIITA targeting sequence
ugauacaaggauagacaaau

SEQ ID NO: 45362 - RNA, 20 nt, Artificial Sequence
  CIITA targeting sequence
agaccauacugucugauuac

SEQ ID NO: 45363 - RNA, 20 nt, Artificial Sequence
  CIITA targeting sequence
uuguaucaagaccauacugu

SEQ ID NO: 45364 - RNA, 20 nt, Artificial Sequence
  CIITA targeting sequence
auccuuguaucaagaccaua

SEQ ID NO: 45365 - RNA, 20 nt, Artificial Sequence
  CIITA targeting sequence
auuugucuauccuuguauca

SEQ ID NO: 45366 - RNA, 20 nt, Artificial Sequence
  CIITA targeting sequence
augaaacuggaguauccaga

SEQ ID NO: 45367 - RNA, 20 nt, Artificial Sequence
  CIITA targeting sequence
uugaucuauuugucuauccu

SEQ ID NO: 45368 - RNA, 20 nt, Artificial Sequence
  CIITA targeting sequence
aguuucauugaucuauuugu

SEQ ID NO: 45369 - RNA, 20 nt, Artificial Sequence
  CIITA targeting sequence
agaaugagacccacaugggu

SEQ ID NO: 45370 - RNA, 20 nt, Artificial Sequence
  CIITA targeting sequence
ggauacuccaguuucauuga

SEQ ID NO: 45371 - RNA, 20 nt, Artificial Sequence
  CIITA targeting sequence
uucuggauacuccaguuuca

SEQ ID NO: 45372 - RNA, 20 nt, Artificial Sequence
  CIITA targeting sequence
cauucuggauacuccaguuu

SEQ ID NO: 45373 - RNA, 20 nt, Artificial Sequence
  CIITA targeting sequence
ccugauuaaugacaauggug

SEQ ID NO: 45374 - RNA, 20 nt, Artificial Sequence
  CIITA targeting sequence
ggugacuacccauguggguc

SEQ ID NO: 45375 - RNA, 20 nt, Artificial Sequence
  CIITA targeting sequence
uuaaucaggugacuacccau

SEQ ID NO: 45376 - RNA, 20 nt, Artificial Sequence
  CIITA targeting sequence
agcgccaccauugucauuaa

SEQ ID NO: 45377 - RNA, 20 nt, Artificial Sequence
  CIITA targeting sequence
acugcacuccagcgccacca

SEQ ID NO: 45378 - RNA, 20 nt, Artificial Sequence
  CIITA targeting sequence
cuacugcacuccagcgccac

SEQ ID NO: 45379 - RNA, 20 nt, Artificial Sequence
  CIITA targeting sequence
cuucucuacugcacuccagc

SEQ ID NO: 45380 - RNA, 20 nt, Artificial Sequence
  CIITA targeting sequence
guaaauggugcugggucaag

SEQ ID NO: 45381 - RNA, 20 nt, Artificial Sequence
  CIITA targeting sequence
aguagauuuccauauagaaa

SEQ ID NO: 45382 - RNA, 20 nt, Artificial Sequence
  CIITA targeting sequence
acuugacccagcaccauuua

SEQ ID NO: 45383 - RNA, 20 nt, Artificial Sequence
  CIITA targeting sequence
auauagaaaaacuuaauuuu

SEQ ID NO: 45384 - RNA, 20 nt, Artificial Sequence
  CIITA targeting sequence
auauggaaaucuacuugacc

SEQ ID NO: 45385 - RNA, 20 nt, Artificial Sequence
  CIITA targeting sequence
uauccuacacagaaaucagu

SEQ ID NO: 45386 - RNA, 20 nt, Artificial Sequence
  CIITA targeting sequence
uacacagaaaucaguuccag

SEQ ID NO: 45387 - RNA, 20 nt, Artificial Sequence
  CIITA targeting sequence
guguaggauaugagguacug

SEQ ID NO: 45388 - RNA, 20 nt, Artificial Sequence
  CIITA targeting sequence
guuccagauguacucaaagu

SEQ ID NO: 45389 - RNA, 20 nt, Artificial Sequence
  CIITA targeting sequence
agauguacucaaagucagaa

SEQ ID NO: 45390 - RNA, 20 nt, Artificial Sequence
  CIITA targeting sequence
ggaacugauuucuguguagg

SEQ ID NO: 45391 - RNA, 20 nt, Artificial Sequence
  CIITA targeting sequence
aagucagaaugcgaagagua

SEQ ID NO: 45392 - RNA, 20 nt, Artificial Sequence
  CIITA targeting sequence
gaaugcgaagaguaaaacag

SEQ ID NO: 45393 - RNA, 20 nt, Artificial Sequence
  CIITA targeting sequence
gacuuugaguacaucuggaa

SEQ ID NO: 45394 - RNA, 20 nt, Artificial Sequence
  CIITA targeting sequence
cauucugacuuugaguacau

SEQ ID NO: 45395 - RNA, 20 nt, Artificial Sequence
  CIITA targeting sequence
ucgcauucugacuuugagua

SEQ ID NO: 45396 - RNA, 20 nt, Artificial Sequence
  CIITA targeting sequence
aacaaaguuacuguuuuacu

SEQ ID NO: 45397 - RNA, 20 nt, Artificial Sequence
  CIITA targeting sequence
uuauaaccuugggguaggua

SEQ ID NO: 45398 - RNA, 20 nt, Artificial Sequence
  CIITA targeting sequence
uaccuaccccaagguuauaa

SEQ ID NO: 45399 - RNA, 20 nt, Artificial Sequence
  CIITA targeting sequence
uaagcuugauacaagaaaca

SEQ ID NO: 45400 - RNA, 20 nt, Artificial Sequence
  CIITA targeting sequence
agcuuaagagguucuuaccu

SEQ ID NO: 45401 - RNA, 20 nt, Artificial Sequence
  CIITA targeting sequence
uguaucaagcuuaagagguu

SEQ ID NO: 45402 - RNA, 20 nt, Artificial Sequence
  CIITA targeting sequence
aagggaaagauuaauaaauu

SEQ ID NO: 45403 - RNA, 20 nt, Artificial Sequence
  CIITA targeting sequence
cuuggaugguguuucuugua

SEQ ID NO: 45404 - RNA, 20 nt, Artificial Sequence
  CIITA targeting sequence
uucccuuggaugguguuucu

SEQ ID NO: 45405 - RNA, 20 nt, Artificial Sequence
  CIITA targeting sequence
auuuauuaaucuuucccuug

SEQ ID NO: 45406 - RNA, 20 nt, Artificial Sequence
  CIITA targeting sequence
uaauuuuaauguaguucaau

SEQ ID NO: 45407 - RNA, 20 nt, Artificial Sequence
  CIITA targeting sequence
acucaucuaaagacccagua

SEQ ID NO: 45408 - RNA, 20 nt, Artificial Sequence
  CIITA targeting sequence
ucuaaagacccaguauaaag

SEQ ID NO: 45409 - RNA, 20 nt, Artificial Sequence
  CIITA targeting sequence
aaagacccaguauaaaggga

SEQ ID NO: 45410 - RNA, 20 nt, Artificial Sequence
  CIITA targeting sequence
uuagaugaguagagguucuu

SEQ ID NO: 45411 - RNA, 20 nt, Artificial Sequence
  CIITA targeting sequence
cuuuauacugggucuuuaga

SEQ ID NO: 45412 - RNA, 20 nt, Artificial Sequence
  CIITA targeting sequence
uucccuuuauacugggucuu

SEQ ID NO: 45413 - RNA, 20 nt, Artificial Sequence
  CIITA targeting sequence
gagaaaguauuugcaauauu

SEQ ID NO: 45414 - RNA, 20 nt, Artificial Sequence
  CIITA targeting sequence
gaugguggcuuaccuuuucg

SEQ ID NO: 45415 - RNA, 20 nt, Artificial Sequence
  CIITA targeting sequence
cugaugguggcuuaccuuuu

SEQ ID NO: 45416 - RNA, 20 nt, Artificial Sequence
  CIITA targeting sequence
ccaguaaaggguuugugguc

SEQ ID NO: 45417 - RNA, 20 nt, Artificial Sequence
  CIITA targeting sequence
aguaaaggguuuguggucag

SEQ ID NO: 45418 - RNA, 20 nt, Artificial Sequence
  CIITA targeting sequence
gaguauauaaagaaaagcaa

SEQ ID NO: 45419 - RNA, 20 nt, Artificial Sequence
  CIITA targeting sequence
gaccacaaacccuuuacugg

SEQ ID NO: 45420 - RNA, 20 nt, Artificial Sequence
  CIITA targeting sequence
uuauauacucugaccacaaa

SEQ ID NO: 45421 - RNA, 20 nt, Artificial Sequence
  CIITA targeting sequence
ugcuuuucuuuauauacucu

SEQ ID NO: 45422 - RNA, 20 nt, Artificial Sequence
  CIITA targeting sequence
cgccuguaauccaaacacuu

SEQ ID NO: 45423 - RNA, 20 nt, Artificial Sequence
  CIITA targeting sequence
aaacacuuugggaggcugag

SEQ ID NO: 45424 - RNA, 20 nt, Artificial Sequence
  CIITA targeting sequence
caaaguguuuggauuacagg

SEQ ID NO: 45425 - RNA, 20 nt, Artificial Sequence
  CIITA targeting sequence
gccucccaaaguguuuggau

SEQ ID NO: 45426 - RNA, 20 nt, Artificial Sequence
  CIITA targeting sequence
acguaccucagccucccaaa

SEQ ID NO: 45427 - RNA, 20 nt, Artificial Sequence
  CIITA targeting sequence
cgaggucaggagaucgagac

SEQ ID NO: 45428 - RNA, 20 nt, Artificial Sequence
  CIITA targeting sequence
ugauccacguaccucagccu

SEQ ID NO: 45429 - RNA, 20 nt, Artificial Sequence
  CIITA targeting sequence
ggagaucgagaccauccugg

SEQ ID NO: 45430 - RNA, 20 nt, Artificial Sequence
  CIITA targeting sequence
ugaccucgugauccacguac

SEQ ID NO: 45431 - RNA, 20 nt, Artificial Sequence
  CIITA targeting sequence
ccugaccucgugauccacgu

SEQ ID NO: 45432 - RNA, 20 nt, Artificial Sequence
  CIITA targeting sequence
agaccauccuggcuaauaca

SEQ ID NO: 45433 - RNA, 20 nt, Artificial Sequence
  CIITA targeting sequence
aucuccugaccucgugaucc

SEQ ID NO: 45434 - RNA, 20 nt, Artificial Sequence
  CIITA targeting sequence
cgaucuccugaccucgugau

SEQ ID NO: 45435 - RNA, 20 nt, Artificial Sequence
  CIITA targeting sequence
uggcuaauacagugaaaccc

SEQ ID NO: 45436 - RNA, 20 nt, Artificial Sequence
  CIITA targeting sequence
cuguauuagccaggaugguc

SEQ ID NO: 45437 - RNA, 20 nt, Artificial Sequence
  CIITA targeting sequence
acuaaaaauacaaaacaauu

SEQ ID NO: 45438 - RNA, 20 nt, Artificial Sequence
  CIITA targeting sequence
gcuaauuguuuuguauuuuu

SEQ ID NO: 45439 - RNA, 20 nt, Artificial Sequence
  CIITA targeting sequence
cagcuauucggaaggcugag

SEQ ID NO: 45440 - RNA, 20 nt, Artificial Sequence
  CIITA targeting sequence
gaaggcugaggcagggaaau

SEQ ID NO: 45441 - RNA, 20 nt, Artificial Sequence
  CIITA targeting sequence
gaauagcugggacuacaggc

SEQ ID NO: 45442 - RNA, 20 nt, Artificial Sequence
  CIITA targeting sequence
gccuuccgaauagcugggac

SEQ ID NO: 45443 - RNA, 20 nt, Artificial Sequence
  CIITA targeting sequence
cugccucagccuuccgaaua

SEQ ID NO: 45444 - RNA, 20 nt, Artificial Sequence
  CIITA targeting sequence
cgccauuucccugccucagc

SEQ ID NO: 45445 - RNA, 20 nt, Artificial Sequence
  CIITA targeting sequence
uggguucacgccauuucccu

SEQ ID NO: 45446 - RNA, 20 nt, Artificial Sequence
  CIITA targeting sequence
gccuccuggguucacgccau

SEQ ID NO: 45447 - RNA, 20 nt, Artificial Sequence
  CIITA targeting sequence
cugcaagcucugccuccugg

SEQ ID NO: 45448 - RNA, 20 nt, Artificial Sequence
  CIITA targeting sequence
acucacugcaagcucugccu

SEQ ID NO: 45449 - RNA, 20 nt, Artificial Sequence
  CIITA targeting sequence
ccacucacugcaagcucugc

SEQ ID NO: 45450 - RNA, 20 nt, Artificial Sequence
  CIITA targeting sequence
caccacugcacuccagccug

SEQ ID NO: 45451 - RNA, 20 nt, Artificial Sequence
  CIITA targeting sequence
agccugggcgacagagcaag

SEQ ID NO: 45452 - RNA, 20 nt, Artificial Sequence
  CIITA targeting sequence
cccaggcuggagugcagugg

SEQ ID NO: 45453 - RNA, 20 nt, Artificial Sequence
  CIITA targeting sequence
gucgcccaggcuggagugca

SEQ ID NO: 45454 - RNA, 20 nt, Artificial Sequence
  CIITA targeting sequence
ugcucugucgcccaggcugg

SEQ ID NO: 45455 - RNA, 20 nt, Artificial Sequence
  CIITA targeting sequence
gucucaaaaaaaaaaaaaug

SEQ ID NO: 45456 - RNA, 20 nt, Artificial Sequence
  CIITA targeting sequence
caaaaaaaaaaaaaugggca

SEQ ID NO: 45457 - RNA, 20 nt, Artificial Sequence
  CIITA targeting sequence
aaaaaaaaaaaaugggcaaa

SEQ ID NO: 45458 - RNA, 20 nt, Artificial Sequence
  CIITA targeting sequence
uuugcccauuuuuuuuuuuu

SEQ ID NO: 45459 - RNA, 20 nt, Artificial Sequence
  CIITA targeting sequence
caaaagaagauauucaaaca

SEQ ID NO: 45460 - RNA, 20 nt, Artificial Sequence
  CIITA targeting sequence
uuugugaggugccugugcaa

SEQ ID NO: 45461 - RNA, 20 nt, Artificial Sequence
  CIITA targeting sequence
ucuuuugugaggugccugug

SEQ ID NO: 45462 - RNA, 20 nt, Artificial Sequence
  CIITA targeting sequence
aacaguccauaaacauauau

SEQ ID NO: 45463 - RNA, 20 nt, Artificial Sequence
  CIITA targeting sequence
auaaacauauaugaacaggc

SEQ ID NO: 45464 - RNA, 20 nt, Artificial Sequence
  CIITA targeting sequence
uauauguuuauggacuguuu

SEQ ID NO: 45465 - RNA, 20 nt, Artificial Sequence
  CIITA targeting sequence
cuacuggaagaaagccccca

SEQ ID NO: 45466 - RNA, 20 nt, Artificial Sequence
  CIITA targeting sequence
aguagugaaaccgggugccu

SEQ ID NO: 45467 - RNA, 20 nt, Artificial Sequence
  CIITA targeting sequence
uccaguagugaaaccgggug

SEQ ID NO: 45468 - RNA, 20 nt, Artificial Sequence
  CIITA targeting sequence
cugcauacccagcagauggc

SEQ ID NO: 45469 - RNA, 20 nt, Artificial Sequence
  CIITA targeting sequence
gcuggguaugcagugauauu

SEQ ID NO: 45470 - RNA, 20 nt, Artificial Sequence
  CIITA targeting sequence
guggcgccaucugcugggua

SEQ ID NO: 45471 - RNA, 20 nt, Artificial Sequence
  CIITA targeting sequence
uugcccuggucgguggcgcc

SEQ ID NO: 45472 - RNA, 20 nt, Artificial Sequence
  CIITA targeting sequence
auacuugguguucuuugccc

SEQ ID NO: 45473 - RNA, 20 nt, Artificial Sequence
  CIITA targeting sequence
caauacuugguguucuuugc

SEQ ID NO: 45474 - RNA, 20 nt, Artificial Sequence
  CIITA targeting sequence
uggccucucaauacuuggug

SEQ ID NO: 45475 - RNA, 20 nt, Artificial Sequence
  CIITA targeting sequence
auuuguuucuuggccucuca

SEQ ID NO: 45476 - RNA, 20 nt, Artificial Sequence
  CIITA targeting sequence
cagaccuuucuuccuggcca

SEQ ID NO: 45477 - RNA, 20 nt, Artificial Sequence
  CIITA targeting sequence
gaccuuucuuccuggccaca

SEQ ID NO: 45478 - RNA, 20 nt, Artificial Sequence
  CIITA targeting sequence
gagaacuccauuuguuucuu

SEQ ID NO: 45479 - RNA, 20 nt, Artificial Sequence
  CIITA targeting sequence
uccuggccacaggucugugg

SEQ ID NO: 45480 - RNA, 20 nt, Artificial Sequence
  CIITA targeting sequence
uggccacaggucugugggcg

SEQ ID NO: 45481 - RNA, 20 nt, Artificial Sequence
  CIITA targeting sequence
gugggcgagcuacugaacgu

SEQ ID NO: 45482 - RNA, 20 nt, Artificial Sequence
  CIITA targeting sequence
cccacagaccuguggccagg

SEQ ID NO: 45483 - RNA, 20 nt, Artificial Sequence
  CIITA targeting sequence
guagcucgcccacagaccug

SEQ ID NO: 45484 - RNA, 20 nt, Artificial Sequence
  CIITA targeting sequence
ccaaaccucacuugcugucu

SEQ ID NO: 45485 - RNA, 20 nt, Artificial Sequence
  CIITA targeting sequence
cuugcugucuuguccugugc

SEQ ID NO: 45486 - RNA, 20 nt, Artificial Sequence
  CIITA targeting sequence
uguccugugcaguggcaaca

SEQ ID NO: 45487 - RNA, 20 nt, Artificial Sequence
  CIITA targeting sequence
ugugcaguggcaacagugug

SEQ ID NO: 45488 - RNA, 20 nt, Artificial Sequence
  CIITA targeting sequence
ucagguuacugugagucugu

SEQ ID NO: 45489 - RNA, 20 nt, Artificial Sequence
  CIITA targeting sequence
gguuacugugagucuguagg

SEQ ID NO: 45490 - RNA, 20 nt, Artificial Sequence
  CIITA targeting sequence
caguaaccugaagaugugca

SEQ ID NO: 45491 - RNA, 20 nt, Artificial Sequence
  CIITA targeting sequence
guaggucacaugaagcccuc

SEQ ID NO: 45492 - RNA, 20 nt, Artificial Sequence
  CIITA targeting sequence
caugaagcccucgcagagaa

SEQ ID NO: 45493 - RNA, 20 nt, Artificial Sequence
  CIITA targeting sequence
ugugaccuacagacucacag

SEQ ID NO: 45494 - RNA, 20 nt, Artificial Sequence
  CIITA targeting sequence
cagagaaccaggcacguggg

SEQ ID NO: 45495 - RNA, 20 nt, Artificial Sequence
  CIITA targeting sequence
gcgagggcuucaugugaccu

SEQ ID NO: 45496 - RNA, 20 nt, Artificial Sequence
  CIITA targeting sequence
cugcgagggcuucaugugac

SEQ ID NO: 45497 - RNA, 20 nt, Artificial Sequence
  CIITA targeting sequence
uagaaucuuuuuuucaggac

SEQ ID NO: 45498 - RNA, 20 nt, Artificial Sequence
  CIITA targeting sequence
aggagcccccacgugccugg

SEQ ID NO: 45499 - RNA, 20 nt, Artificial Sequence
  CIITA targeting sequence
uuuuuucaggacuuaccgcc

SEQ ID NO: 45500 - RNA, 20 nt, Artificial Sequence
  CIITA targeting sequence
ggacuuaccgcccugcccuc

SEQ ID NO: 45501 - RNA, 20 nt, Artificial Sequence
  CIITA targeting sequence
ugaaaaaaagauucuaggag

SEQ ID NO: 45502 - RNA, 20 nt, Artificial Sequence
  CIITA targeting sequence
cugccuauaagggccuucug

SEQ ID NO: 45503 - RNA, 20 nt, Artificial Sequence
  CIITA targeting sequence
gccuauaagggccuucuggu

SEQ ID NO: 45504 - RNA, 20 nt, Artificial Sequence
  CIITA targeting sequence
gguaguuacuaggucuuuuu

SEQ ID NO: 45505 - RNA, 20 nt, Artificial Sequence
  CIITA targeting sequence
uuuucccccagaaauuauuu

SEQ ID NO: 45506 - RNA, 20 nt, Artificial Sequence
  CIITA targeting sequence
cccagaaauuauuuaauaag

SEQ ID NO: 45507 - RNA, 20 nt, Artificial Sequence
  CIITA targeting sequence
gggggaaaaagaccuaguaa

SEQ ID NO: 45508 - RNA, 20 nt, Artificial Sequence
  CIITA targeting sequence
uacauaguaacugccaaguu

SEQ ID NO: 45509 - RNA, 20 nt, Artificial Sequence
  CIITA targeting sequence
guuaucucccaacaccacca

SEQ ID NO: 45510 - RNA, 20 nt, Artificial Sequence
  CIITA targeting sequence
cccaacaccaccaaaauagg

SEQ ID NO: 45511 - RNA, 20 nt, Artificial Sequence
  CIITA targeting sequence
caacaccaccaaaauaggua

SEQ ID NO: 45512 - RNA, 20 nt, Artificial Sequence
  CIITA targeting sequence
accuauuuuggugguguugg

SEQ ID NO: 45513 - RNA, 20 nt, Artificial Sequence
  CIITA targeting sequence
gguaccauugcuguuuacau

SEQ ID NO: 45514 - RNA, 20 nt, Artificial Sequence
  CIITA targeting sequence
ccaguaaaauguaaacagca

SEQ ID NO: 45515 - RNA, 20 nt, Artificial Sequence
  CIITA targeting sequence
caccaguaaaauguaaacag

SEQ ID NO: 45516 - RNA, 20 nt, Artificial Sequence
  CIITA targeting sequence
guugucucaccaguaaaaug

SEQ ID NO: 45517 - RNA, 20 nt, Artificial Sequence
  CIITA targeting sequence
gugcaccucaguugucucac

SEQ ID NO: 45518 - RNA, 20 nt, Artificial Sequence
  CIITA targeting sequence
cucugugcaccucaguuguc

SEQ ID NO: 45519 - RNA, 20 nt, Artificial Sequence
  CIITA targeting sequence
ggaucacccagcuaauaagu

SEQ ID NO: 45520 - RNA, 20 nt, Artificial Sequence
  CIITA targeting sequence
ugagcagguuacuuucccuc

SEQ ID NO: 45521 - RNA, 20 nt, Artificial Sequence
  CIITA targeting sequence
cccagcuaauaagugaugga

SEQ ID NO: 45522 - RNA, 20 nt, Artificial Sequence
  CIITA targeting sequence
cuuauuagcugggugauccu

SEQ ID NO: 45523 - RNA, 20 nt, Artificial Sequence
  CIITA targeting sequence
aucacuuauuagcuggguga

SEQ ID NO: 45524 - RNA, 20 nt, Artificial Sequence
  CIITA targeting sequence
gacccaggcauuccaguguc

SEQ ID NO: 45525 - RNA, 20 nt, Artificial Sequence
  CIITA targeting sequence
gagcacaccuccaucacuua

SEQ ID NO: 45526 - RNA, 20 nt, Artificial Sequence
  CIITA targeting sequence
agugucugugauuaacccua

SEQ ID NO: 45527 - RNA, 20 nt, Artificial Sequence
  CIITA targeting sequence
gugauuaacccuauguucua

SEQ ID NO: 45528 - RNA, 20 nt, Artificial Sequence
  CIITA targeting sequence
cagacacuggaaugccuggg

SEQ ID NO: 45529 - RNA, 20 nt, Artificial Sequence
  CIITA targeting sequence
aauuauaccaguguuuguaa

SEQ ID NO: 45530 - RNA, 20 nt, Artificial Sequence
  CIITA targeting sequence
agugccucucaggaaauacc

SEQ ID NO: 45531 - RNA, 20 nt, Artificial Sequence
  CIITA targeting sequence
caggaaauaccagacuuucu

SEQ ID NO: 45532 - RNA, 20 nt, Artificial Sequence
  CIITA targeting sequence
ggaaauaccagacuuucucu

SEQ ID NO: 45533 - RNA, 20 nt, Artificial Sequence
  CIITA targeting sequence
ugagaggcacuagaguauau

SEQ ID NO: 45534 - RNA, 20 nt, Artificial Sequence
  CIITA targeting sequence
gguauuuccugagaggcacu

SEQ ID NO: 45535 - RNA, 20 nt, Artificial Sequence
  CIITA targeting sequence
cuacuuccugcucugguuuc

SEQ ID NO: 45536 - RNA, 20 nt, Artificial Sequence
  CIITA targeting sequence
acuuccugcucugguuucgc

SEQ ID NO: 45537 - RNA, 20 nt, Artificial Sequence
  CIITA targeting sequence
ugcucugguuucgcugaacc

SEQ ID NO: 45538 - RNA, 20 nt, Artificial Sequence
  CIITA targeting sequence
gguuucgcugaaccuuccca

SEQ ID NO: 45539 - RNA, 20 nt, Artificial Sequence
  CIITA targeting sequence
cugaaccuucccaucacgac

SEQ ID NO: 45540 - RNA, 20 nt, Artificial Sequence
  CIITA targeting sequence
gcgaaaccagagcaggaagu

SEQ ID NO: 45541 - RNA, 20 nt, Artificial Sequence
  CIITA targeting sequence
caucacgacuccugcccuga

SEQ ID NO: 45542 - RNA, 20 nt, Artificial Sequence
  CIITA targeting sequence
cgacuccugcccugaagccc

SEQ ID NO: 45543 - RNA, 20 nt, Artificial Sequence
  CIITA targeting sequence
ugaugggaagguucagcgaa

SEQ ID NO: 45544 - RNA, 20 nt, Artificial Sequence
  CIITA targeting sequence
ugcccugaagcccucuuucc

SEQ ID NO: 45545 - RNA, 20 nt, Artificial Sequence
  CIITA targeting sequence
gggcaggagucgugauggga

SEQ ID NO: 45546 - RNA, 20 nt, Artificial Sequence
  CIITA targeting sequence
uucccuguuugaaucuagcc

SEQ ID NO: 45547 - RNA, 20 nt, Artificial Sequence
  CIITA targeting sequence
cuguuugaaucuagccugau

SEQ ID NO: 45548 - RNA, 20 nt, Artificial Sequence
  CIITA targeting sequence
aacagggaaagagggcuuca

SEQ ID NO: 45549 - RNA, 20 nt, Artificial Sequence
  CIITA targeting sequence
agccugaucucuuuucuacc

SEQ ID NO: 45550 - RNA, 20 nt, Artificial Sequence
  CIITA targeting sequence
ggcuagauucaaacagggaa

SEQ ID NO: 45551 - RNA, 20 nt, Artificial Sequence
  CIITA targeting sequence
cuuuucuaccuuccuggaau

SEQ ID NO: 45552 - RNA, 20 nt, Artificial Sequence
  CIITA targeting sequence
uuucuaccuuccuggaauau

SEQ ID NO: 45553 - RNA, 20 nt, Artificial Sequence
  CIITA targeting sequence
accuuccuggaauauuccuu

SEQ ID NO: 45554 - RNA, 20 nt, Artificial Sequence
  CIITA targeting sequence
uggaauauuccuuagauaau

SEQ ID NO: 45555 - RNA, 20 nt, Artificial Sequence
  CIITA targeting sequence
aggaagguagaaaagagauc

SEQ ID NO: 45556 - RNA, 20 nt, Artificial Sequence
  CIITA targeting sequence
uuagauaauguaguaauaau

SEQ ID NO: 45557 - RNA, 20 nt, Artificial Sequence
  CIITA targeting sequence
aaggaauauuccaggaaggu

SEQ ID NO: 45558 - RNA, 20 nt, Artificial Sequence
  CIITA targeting sequence
cauuauuacuacauuaucua

SEQ ID NO: 45559 - RNA, 20 nt, Artificial Sequence
  CIITA targeting sequence
uuguggugggggccguuauu

SEQ ID NO: 45560 - RNA, 20 nt, Artificial Sequence
  CIITA targeting sequence
aaucaccauggcagccaagc

SEQ ID NO: 45561 - RNA, 20 nt, Artificial Sequence
  CIITA targeting sequence
ccauggcagccaagccugcu

SEQ ID NO: 45562 - RNA, 20 nt, Artificial Sequence
  CIITA targeting sequence
guugagcccuugcucugugc

SEQ ID NO: 45563 - RNA, 20 nt, Artificial Sequence
  CIITA targeting sequence
acagaagcaggcuuggcugc

SEQ ID NO: 45564 - RNA, 20 nt, Artificial Sequence
  CIITA targeting sequence
gugccaggcgcugugcuugg

SEQ ID NO: 45565 - RNA, 20 nt, Artificial Sequence
  CIITA targeting sequence
uucugugcauggucacguug

SEQ ID NO: 45566 - RNA, 20 nt, Artificial Sequence
  CIITA targeting sequence
gugcauggucacguugccuc

SEQ ID NO: 45567 - RNA, 20 nt, Artificial Sequence
  CIITA targeting sequence
cguugccucucuggaacaac

SEQ ID NO: 45568 - RNA, 20 nt, Artificial Sequence
  CIITA targeting sequence
cuggaacaacccagugagga

SEQ ID NO: 45569 - RNA, 20 nt, Artificial Sequence
  CIITA targeting sequence
ggaacaacccagugaggaag

SEQ ID NO: 45570 - RNA, 20 nt, Artificial Sequence
  CIITA targeting sequence
agagaggcaacgugaccaug

SEQ ID NO: 45571 - RNA, 20 nt, Artificial Sequence
  CIITA targeting sequence
cuggguuguuccagagaggc

SEQ ID NO: 45572 - RNA, 20 nt, Artificial Sequence
  CIITA targeting sequence
ucacuggguuguuccagaga

SEQ ID NO: 45573 - RNA, 20 nt, Artificial Sequence
  CIITA targeting sequence
aggcuuccucacuggguugu

SEQ ID NO: 45574 - RNA, 20 nt, Artificial Sequence
  CIITA targeting sequence
caccacuguguagaaucuga

SEQ ID NO: 45575 - RNA, 20 nt, Artificial Sequence
  CIITA targeting sequence
acacaguggugggaacaguc

SEQ ID NO: 45576 - RNA, 20 nt, Artificial Sequence
  CIITA targeting sequence
gagcugcagagaggugaagc

SEQ ID NO: 45577 - RNA, 20 nt, Artificial Sequence
  CIITA targeting sequence
gauucuacacagugguggga

SEQ ID NO: 45578 - RNA, 20 nt, Artificial Sequence
  CIITA targeting sequence
gcagcucagauucuacacag

SEQ ID NO: 45579 - RNA, 20 nt, Artificial Sequence
  CIITA targeting sequence
cugcagcucagauucuacac

SEQ ID NO: 45580 - RNA, 20 nt, Artificial Sequence
  CIITA targeting sequence
ccucucugcagcucagauuc

SEQ ID NO: 45581 - RNA, 20 nt, Artificial Sequence
  CIITA targeting sequence
aaggccacaguuaggaggug

SEQ ID NO: 45582 - RNA, 20 nt, Artificial Sequence
  CIITA targeting sequence
uaacuguggccuuggacaag

SEQ ID NO: 45583 - RNA, 20 nt, Artificial Sequence
  CIITA targeting sequence
agcccaagucugucugccag

SEQ ID NO: 45584 - RNA, 20 nt, Artificial Sequence
  CIITA targeting sequence
gucugccagacuccgaagcc

SEQ ID NO: 45585 - RNA, 20 nt, Artificial Sequence
  CIITA targeting sequence
gccagacuccgaagccugac

SEQ ID NO: 45586 - RNA, 20 nt, Artificial Sequence
  CIITA targeting sequence
ggcagacagacuugggcuug

SEQ ID NO: 45587 - RNA, 20 nt, Artificial Sequence
  CIITA targeting sequence
gaagccugaccucuucacca

SEQ ID NO: 45588 - RNA, 20 nt, Artificial Sequence
  CIITA targeting sequence
gagucuggcagacagacuug

SEQ ID NO: 45589 - RNA, 20 nt, Artificial Sequence
  CIITA targeting sequence
ggcuucggagucuggcagac

SEQ ID NO: 45590 - RNA, 20 nt, Artificial Sequence
  CIITA targeting sequence
ucaccagagcucugugcugu

SEQ ID NO: 45591 - RNA, 20 nt, Artificial Sequence
  CIITA targeting sequence
ccagagcucugugcugucac

SEQ ID NO: 45592 - RNA, 20 nt, Artificial Sequence
  CIITA targeting sequence
ggugaagaggucaggcuucg

SEQ ID NO: 45593 - RNA, 20 nt, Artificial Sequence
  CIITA targeting sequence
gugcugucacuugccguguc

SEQ ID NO: 45594 - RNA, 20 nt, Artificial Sequence
  CIITA targeting sequence
cuugccgugucuggcguuug

SEQ ID NO: 45595 - RNA, 20 nt, Artificial Sequence
  CIITA targeting sequence
ggcguuuggaucccuggcua

SEQ ID NO: 45596 - RNA, 20 nt, Artificial Sequence
  CIITA targeting sequence
aaacgccagacacggcaagu

SEQ ID NO: 45597 - RNA, 20 nt, Artificial Sequence
  CIITA targeting sequence
cuggcuauguucagucgugu

SEQ ID NO: 45598 - RNA, 20 nt, Artificial Sequence
  CIITA targeting sequence
gucguguaugcuuugaucua

SEQ ID NO: 45599 - RNA, 20 nt, Artificial Sequence
  CIITA targeting sequence
uguaugcuuugaucuaaguu

SEQ ID NO: 45600 - RNA, 20 nt, Artificial Sequence
  CIITA targeting sequence
aagcauacacgacugaacau

SEQ ID NO: 45601 - RNA, 20 nt, Artificial Sequence
  CIITA targeting sequence
aaguuauguuuacaaagacc

SEQ ID NO: 45602 - RNA, 20 nt, Artificial Sequence
  CIITA targeting sequence
uuguaaacauaacuuagauc

SEQ ID NO: 45603 - RNA, 20 nt, Artificial Sequence
  CIITA targeting sequence
ccugccccauucagcauuua

SEQ ID NO: 45604 - RNA, 20 nt, Artificial Sequence
  CIITA targeting sequence
gcauuuauugaacaccugcu

SEQ ID NO: 45605 - RNA, 20 nt, Artificial Sequence
  CIITA targeting sequence
auaaaugcugaauggggcag

SEQ ID NO: 45606 - RNA, 20 nt, Artificial Sequence
  CIITA targeting sequence
gacauuuggaguguauuggg

SEQ ID NO: 45607 - RNA, 20 nt, Artificial Sequence
  CIITA targeting sequence
gauacacagcagguguucaa

SEQ ID NO: 45608 - RNA, 20 nt, Artificial Sequence
  CIITA targeting sequence
aaaugucugauacacagcag

SEQ ID NO: 45609 - RNA, 20 nt, Artificial Sequence
  CIITA targeting sequence
gcaagaucaauaaggugaug

SEQ ID NO: 45610 - RNA, 20 nt, Artificial Sequence
  CIITA targeting sequence
ugcugaccccaauacacucc

SEQ ID NO: 45611 - RNA, 20 nt, Artificial Sequence
  CIITA targeting sequence
auaaggugauggugcugacc

SEQ ID NO: 45612 - RNA, 20 nt, Artificial Sequence
  CIITA targeting sequence
ccuuauugaucuugcugacc

SEQ ID NO: 45613 - RNA, 20 nt, Artificial Sequence
  CIITA targeting sequence
gcaccaucaccuuauugauc

SEQ ID NO: 45614 - RNA, 20 nt, Artificial Sequence
  CIITA targeting sequence
aggucagcaccaucaccuua

SEQ ID NO: 45615 - RNA, 20 nt, Artificial Sequence
  CIITA targeting sequence
ucaaggucagcaccaucacc

SEQ ID NO: 45616 - RNA, 20 nt, Artificial Sequence
  CIITA targeting sequence
ggucuaguaugggaggcaga

SEQ ID NO: 45617 - RNA, 20 nt, Artificial Sequence
  CIITA targeting sequence
aguaugggaggcagaucuuu

SEQ ID NO: 45618 - RNA, 20 nt, Artificial Sequence
  CIITA targeting sequence
cauacuagaccugagcuccu

SEQ ID NO: 45619 - RNA, 20 nt, Artificial Sequence
  CIITA targeting sequence
gccucccauacuagaccuga

SEQ ID NO: 45620 - RNA, 20 nt, Artificial Sequence
  CIITA targeting sequence
uugcaaaugagggugggcug

SEQ ID NO: 45621 - RNA, 20 nt, Artificial Sequence
  CIITA targeting sequence
uuugcaaagaucugccuccc

SEQ ID NO: 45622 - RNA, 20 nt, Artificial Sequence
  CIITA targeting sequence
guacccacacauauuugcua

SEQ ID NO: 45623 - RNA, 20 nt, Artificial Sequence
  CIITA targeting sequence
cuggcaccucuguacccaca

SEQ ID NO: 45624 - RNA, 20 nt, Artificial Sequence
  CIITA targeting sequence
ucacuggcaccucuguaccc

SEQ ID NO: 45625 - RNA, 20 nt, Artificial Sequence
  CIITA targeting sequence
cuccucacuggcaccucugu

SEQ ID NO: 45626 - RNA, 20 nt, Artificial Sequence
  CIITA targeting sequence
accugggaggggggcauggg

SEQ ID NO: 45627 - RNA, 20 nt, Artificial Sequence
  CIITA targeting sequence
cagguggauuuaauuguucc

SEQ ID NO: 45628 - RNA, 20 nt, Artificial Sequence
  CIITA targeting sequence
ccaugccccccucccaggug

SEQ ID NO: 45629 - RNA, 20 nt, Artificial Sequence
  CIITA targeting sequence
ugguaaagcguuccccaugc

SEQ ID NO: 45630 - RNA, 20 nt, Artificial Sequence
  CIITA targeting sequence
cuugguaaagcguuccccau

SEQ ID NO: 45631 - RNA, 20 nt, Artificial Sequence
  CIITA targeting sequence
ggcaucucuugguaaagcgu

SEQ ID NO: 45632 - RNA, 20 nt, Artificial Sequence
  CIITA targeting sequence
aaacccagcucgggcaucuc

SEQ ID NO: 45633 - RNA, 20 nt, Artificial Sequence
  CIITA targeting sequence
agcaaacuuuuacauuucaa

SEQ ID NO: 45634 - RNA, 20 nt, Artificial Sequence
  CIITA targeting sequence
uccagcaaacuuuuacauuu

SEQ ID NO: 45635 - RNA, 20 nt, Artificial Sequence
  CIITA targeting sequence
uugucauccagcaaacuuuu

SEQ ID NO: 45636 - RNA, 20 nt, Artificial Sequence
  CIITA targeting sequence
aagcagaaagccccaucaau

SEQ ID NO: 45637 - RNA, 20 nt, Artificial Sequence
  CIITA targeting sequence
gcuuagaaugcccuugcugu

SEQ ID NO: 45638 - RNA, 20 nt, Artificial Sequence
  CIITA targeting sequence
auugaagucaugugguccua

SEQ ID NO: 45639 - RNA, 20 nt, Artificial Sequence
  CIITA targeting sequence
auugauggggcuuucugcuu

SEQ ID NO: 45640 - RNA, 20 nt, Artificial Sequence
  CIITA targeting sequence
ugugguccuaaagaauuuaa

SEQ ID NO: 45641 - RNA, 20 nt, Artificial Sequence
  CIITA targeting sequence
uaaagaauuuaaaauuucuu

SEQ ID NO: 45642 - RNA, 20 nt, Artificial Sequence
  CIITA targeting sequence
uuaggaccacaugacuucaa

SEQ ID NO: 45643 - RNA, 20 nt, Artificial Sequence
  CIITA targeting sequence
ucuucuuguuggggaucuuc

SEQ ID NO: 45644 - RNA, 20 nt, Artificial Sequence
  CIITA targeting sequence
ucuuguuggggaucuucaga

SEQ ID NO: 45645 - RNA, 20 nt, Artificial Sequence
  CIITA targeting sequence
uguuggggaucuucagagca

SEQ ID NO: 45646 - RNA, 20 nt, Artificial Sequence
  CIITA targeting sequence
ccaacaagaagaagaaauuu

SEQ ID NO: 45647 - RNA, 20 nt, Artificial Sequence
  CIITA targeting sequence
ucagagcagacccacccacc

SEQ ID NO: 45648 - RNA, 20 nt, Artificial Sequence
  CIITA targeting sequence
gagcagacccacccaccuaa

SEQ ID NO: 45649 - RNA, 20 nt, Artificial Sequence
  CIITA targeting sequence
gaagauccccaacaagaaga

SEQ ID NO: 45650 - RNA, 20 nt, Artificial Sequence
  CIITA targeting sequence
gcucugaagauccccaacaa

SEQ ID NO: 45651 - RNA, 20 nt, Artificial Sequence
  CIITA targeting sequence
cccauugaccaggaguauga

SEQ ID NO: 45652 - RNA, 20 nt, Artificial Sequence
  CIITA targeting sequence
cauugaccaggaguaugaug

SEQ ID NO: 45653 - RNA, 20 nt, Artificial Sequence
  CIITA targeting sequence
augggagacgguggcuuagg

SEQ ID NO: 45654 - RNA, 20 nt, Artificial Sequence
  CIITA targeting sequence
uggucaaugggagacggugg

SEQ ID NO: 45655 - RNA, 20 nt, Artificial Sequence
  CIITA targeting sequence
uacuccuggucaaugggaga

SEQ ID NO: 45656 - RNA, 20 nt, Artificial Sequence
  CIITA targeting sequence
cacaucauacuccuggucaa

SEQ ID NO: 45657 - RNA, 20 nt, Artificial Sequence
  CIITA targeting sequence
auuagcaucacacaucauac

SEQ ID NO: 45658 - RNA, 20 nt, Artificial Sequence
  CIITA targeting sequence
guguacaucuauuagcauca

SEQ ID NO: 45659 - RNA, 20 nt, Artificial Sequence
  CIITA targeting sequence
ucuguguacaucuauuagca

SEQ ID NO: 45660 - RNA, 20 nt, Artificial Sequence
  CIITA targeting sequence
cuucuguguacaucuauuag

SEQ ID NO: 45661 - RNA, 20 nt, Artificial Sequence
  CIITA targeting sequence
ucucuucuguguacaucuau

SEQ ID NO: 45662 - RNA, 20 nt, Artificial Sequence
  CIITA targeting sequence
cuccucucuucuguguacau

SEQ ID NO: 45663 - RNA, 20 nt, Artificial Sequence
  CIITA targeting sequence
cccuccucucuucuguguac

SEQ ID NO: 45664 - RNA, 20 nt, Artificial Sequence
  CIITA targeting sequence
gcccuucucccauauugcca

SEQ ID NO: 45665 - RNA, 20 nt, Artificial Sequence
  CIITA targeting sequence
cccauauugccaacgauguc

SEQ ID NO: 45666 - RNA, 20 nt, Artificial Sequence
  CIITA targeting sequence
cauauugccaacgaugucuu

SEQ ID NO: 45667 - RNA, 20 nt, Artificial Sequence
  CIITA targeting sequence
uuggcaauaugggagaaggg

SEQ ID NO: 45668 - RNA, 20 nt, Artificial Sequence
  CIITA targeting sequence
ugucacuggcagggugucag

SEQ ID NO: 45669 - RNA, 20 nt, Artificial Sequence
  CIITA targeting sequence
cuggcagggugucaggcaca

SEQ ID NO: 45670 - RNA, 20 nt, Artificial Sequence
  CIITA targeting sequence
ggcacaugggggccugcgug

SEQ ID NO: 45671 - RNA, 20 nt, Artificial Sequence
  CIITA targeting sequence
acgcaggcccccaugugccu

SEQ ID NO: 45672 - RNA, 20 nt, Artificial Sequence
  CIITA targeting sequence
ccacgcaggcccccaugugc

SEQ ID NO: 45673 - RNA, 20 nt, Artificial Sequence
  CIITA targeting sequence
cugauggccacagcuggagu

SEQ ID NO: 45674 - RNA, 20 nt, Artificial Sequence
  CIITA targeting sequence
gugacacucuccacgcaggc

SEQ ID NO: 45675 - RNA, 20 nt, Artificial Sequence
  CIITA targeting sequence
agcuguggccaucagugaca

SEQ ID NO: 45676 - RNA, 20 nt, Artificial Sequence
  CIITA targeting sequence
ccgcaccacuccagcugugg

SEQ ID NO: 45677 - RNA, 20 nt, Artificial Sequence
  CIITA targeting sequence
gacuucagugggauuggggc

SEQ ID NO: 45678 - RNA, 20 nt, Artificial Sequence
  CIITA targeting sequence
gacagucaccgcaccacucc

SEQ ID NO: 45679 - RNA, 20 nt, Artificial Sequence
  CIITA targeting sequence
gugggauuggggcccugcac

SEQ ID NO: 45680 - RNA, 20 nt, Artificial Sequence
  CIITA targeting sequence
cacugaagucugacagucac

SEQ ID NO: 45681 - RNA, 20 nt, Artificial Sequence
  CIITA targeting sequence
aauucaaugggucugggaca

SEQ ID NO: 45682 - RNA, 20 nt, Artificial Sequence
  CIITA targeting sequence
augggucugggacaacuuac

SEQ ID NO: 45683 - RNA, 20 nt, Artificial Sequence
  CIITA targeting sequence
gggacaacuuacaaagguga

SEQ ID NO: 45684 - RNA, 20 nt, Artificial Sequence
  CIITA targeting sequence
cagacccauugaauuggacu

SEQ ID NO: 45685 - RNA, 20 nt, Artificial Sequence
  CIITA targeting sequence
ccuuuguaaguugucccaga

SEQ ID NO: 45686 - RNA, 20 nt, Artificial Sequence
  CIITA targeting sequence
gaugcaggaugccugggaac

SEQ ID NO: 45687 - RNA, 20 nt, Artificial Sequence
  CIITA targeting sequence
gaaucaccuuuguaaguugu

SEQ ID NO: 45688 - RNA, 20 nt, Artificial Sequence
  CIITA targeting sequence
ugcaucagaaucaccuuugu

SEQ ID NO: 45689 - RNA, 20 nt, Artificial Sequence
  CIITA targeting sequence
caggcauccugcaucagaau

SEQ ID NO: 45690 - RNA, 20 nt, Artificial Sequence
  CIITA targeting sequence
aaacugcaguucccaggcau

SEQ ID NO: 45691 - RNA, 20 nt, Artificial Sequence
  CIITA targeting sequence
gccguuugaaacucuugggg

SEQ ID NO: 45692 - RNA, 20 nt, Artificial Sequence
  CIITA targeting sequence
aacggcagaguuuuccaaac

SEQ ID NO: 45693 - RNA, 20 nt, Artificial Sequence
  CIITA targeting sequence
uggggaagaugcacuugagg

SEQ ID NO: 45694 - RNA, 20 nt, Artificial Sequence
  CIITA targeting sequence
ccaagaguuucaaacggcag

SEQ ID NO: 45695 - RNA, 20 nt, Artificial Sequence
  CIITA targeting sequence
uccccaagaguuucaaacgg

SEQ ID NO: 45696 - RNA, 20 nt, Artificial Sequence
  CIITA targeting sequence
agugcaucuuccccaagagu

SEQ ID NO: 45697 - RNA, 20 nt, Artificial Sequence
  CIITA targeting sequence
ugccucaagugcaucuuccc

SEQ ID NO: 45698 - RNA, 20 nt, Artificial Sequence
  CIITA targeting sequence
ucuugccucaagugcaucuu

SEQ ID NO: 45699 - RNA, 20 nt, Artificial Sequence
  CIITA targeting sequence
ucaucuugccucaagugcau

SEQ ID NO: 45700 - RNA, 20 nt, Artificial Sequence
  CIITA targeting sequence
acaucuucaucuugccucaa

SEQ ID NO: 45701 - RNA, 20 nt, Artificial Sequence
  CIITA targeting sequence
caaaucuacaucuucaucuu

SEQ ID NO: 45702 - RNA, 20 nt, Artificial Sequence
  CIITA targeting sequence
uccaaugauucaucccaggg

SEQ ID NO: 45703 - RNA, 20 nt, Artificial Sequence
  CIITA targeting sequence
aaugauucaucccagggugg

SEQ ID NO: 45704 - RNA, 20 nt, Artificial Sequence
  CIITA targeting sequence
uuggaggacccacucccaaa

SEQ ID NO: 45705 - RNA, 20 nt, Artificial Sequence
  CIITA targeting sequence
ucccagggugguucaagugc

SEQ ID NO: 45706 - RNA, 20 nt, Artificial Sequence
  CIITA targeting sequence
cagggugguucaagugcugu

SEQ ID NO: 45707 - RNA, 20 nt, Artificial Sequence
  CIITA targeting sequence
agugcuguuugaguuaccua

SEQ ID NO: 45708 - RNA, 20 nt, Artificial Sequence
  CIITA targeting sequence
aacagcacuugaaccacccu

SEQ ID NO: 45709 - RNA, 20 nt, Artificial Sequence
  CIITA targeting sequence
auaauuagguaacucaaaca

SEQ ID NO: 45710 - RNA, 20 nt, Artificial Sequence
  CIITA targeting sequence
cucuauaauuagguaacuca

SEQ ID NO: 45711 - RNA, 20 nt, Artificial Sequence
  CIITA targeting sequence
cgcagccuuuugguagauuu

SEQ ID NO: 45712 - RNA, 20 nt, Artificial Sequence
  CIITA targeting sequence
accaaaaggcugcgggaggg

SEQ ID NO: 45713 - RNA, 20 nt, Artificial Sequence
  CIITA targeting sequence
accacuuguacccaaaucua

SEQ ID NO: 45714 - RNA, 20 nt, Artificial Sequence
  CIITA targeting sequence
ucaaccacuuguacccaaau

SEQ ID NO: 45715 - RNA, 20 nt, Artificial Sequence
  CIITA targeting sequence
aaaaacacaaauccucaacc

SEQ ID NO: 45716 - RNA, 20 nt, Artificial Sequence
  CIITA targeting sequence
ucuaauuacugcauauuaaa

SEQ ID NO: 45717 - RNA, 20 nt, Artificial Sequence
  CIITA targeting sequence
aauuacugcauauuaaaaau

SEQ ID NO: 45718 - RNA, 20 nt, Artificial Sequence
  CIITA targeting sequence
aauaaauuaauuaaaugcuu

SEQ ID NO: 45719 - RNA, 20 nt, Artificial Sequence
  CIITA targeting sequence
agcauuuaauuaauuuauua

SEQ ID NO: 45720 - RNA, 20 nt, Artificial Sequence
  CIITA targeting sequence
uuaaagcauaacaaacagua

SEQ ID NO: 45721 - RNA, 20 nt, Artificial Sequence
  CIITA targeting sequence
uaaauaaacccuagccccuu

SEQ ID NO: 45722 - RNA, 20 nt, Artificial Sequence
  CIITA targeting sequence
gcuauuuaaaggggcuaggg

SEQ ID NO: 45723 - RNA, 20 nt, Artificial Sequence
  CIITA targeting sequence
uuauuguuucaucuucaggc

SEQ ID NO: 45724 - RNA, 20 nt, Artificial Sequence
  CIITA targeting sequence
ucuucaggcugcuuccucuu

SEQ ID NO: 45725 - RNA, 20 nt, Artificial Sequence
  CIITA targeting sequence
ucaggcugcuuccucuuuau

SEQ ID NO: 45726 - RNA, 20 nt, Artificial Sequence
  CIITA targeting sequence
ggcugcuuccucuuuauguc

SEQ ID NO: 45727 - RNA, 20 nt, Artificial Sequence
  CIITA targeting sequence
ucuuuaugucuuacccguuu

SEQ ID NO: 45728 - RNA, 20 nt, Artificial Sequence
  CIITA targeting sequence
uuaugucuuacccguuuuua

SEQ ID NO: 45729 - RNA, 20 nt, Artificial Sequence
  CIITA targeting sequence
uacccguuuuuagagauugu

SEQ ID NO: 45730 - RNA, 20 nt, Artificial Sequence
  CIITA targeting sequence
aaaaacggguaagacauaaa

SEQ ID NO: 45731 - RNA, 20 nt, Artificial Sequence
  CIITA targeting sequence
cuaaaaacggguaagacaua

SEQ ID NO: 45732 - RNA, 20 nt, Artificial Sequence
  CIITA targeting sequence
acaaucucuaaaaacgggua

SEQ ID NO: 45733 - RNA, 20 nt, Artificial Sequence
  CIITA targeting sequence
caucuacaaucucuaaaaac

SEQ ID NO: 45734 - RNA, 20 nt, Artificial Sequence
  CIITA targeting sequence
uaucuagacguuuccuuccu

SEQ ID NO: 45735 - RNA, 20 nt, Artificial Sequence
  CIITA targeting sequence
agacguuuccuuccuugcuc

SEQ ID NO: 45736 - RNA, 20 nt, Artificial Sequence
  CIITA targeting sequence
agauaggauugucccaucua

SEQ ID NO: 45737 - RNA, 20 nt, Artificial Sequence
  CIITA targeting sequence
uuccuugcucucaccagacc

SEQ ID NO: 45738 - RNA, 20 nt, Artificial Sequence
  CIITA targeting sequence
uugcucucaccagaccccca

SEQ ID NO: 45739 - RNA, 20 nt, Artificial Sequence
  CIITA targeting sequence
caccagacccccagcccuga

SEQ ID NO: 45740 - RNA, 20 nt, Artificial Sequence
  CIITA targeting sequence
ccagacccccagcccugaaa

SEQ ID NO: 45741 - RNA, 20 nt, Artificial Sequence
  CIITA targeting sequence
ggugagagcaaggaaggaaa

SEQ ID NO: 45742 - RNA, 20 nt, Artificial Sequence
  CIITA targeting sequence
gggcugggggucuggugaga

SEQ ID NO: 45743 - RNA, 20 nt, Artificial Sequence
  CIITA targeting sequence
guuuucagggcugggggucu

SEQ ID NO: 45744 - RNA, 20 nt, Artificial Sequence
  CIITA targeting sequence
uuuauggcuaacuucaguuu

SEQ ID NO: 45745 - RNA, 20 nt, Artificial Sequence
  CIITA targeting sequence
ggagaggagggcccuuuucc

SEQ ID NO: 45746 - RNA, 20 nt, Artificial Sequence
  CIITA targeting sequence
ugauuucuuuuauggcuaac

SEQ ID NO: 45747 - RNA, 20 nt, Artificial Sequence
  CIITA targeting sequence
ccugauuucuuuuauggcua

SEQ ID NO: 45748 - RNA, 20 nt, Artificial Sequence
  CIITA targeting sequence
ucuccugauuucuuuuaugg

SEQ ID NO: 45749 - RNA, 20 nt, Artificial Sequence
  CIITA targeting sequence
ugagucacuuccucuuggug

SEQ ID NO: 45750 - RNA, 20 nt, Artificial Sequence
  CIITA targeting sequence
ggaaaagggcccuccucucc

SEQ ID NO: 45751 - RNA, 20 nt, Artificial Sequence
  CIITA targeting sequence
cuuccucuuggugucugcuu

SEQ ID NO: 45752 - RNA, 20 nt, Artificial Sequence
  CIITA targeting sequence
ucuuggugucugcuuuuccu

SEQ ID NO: 45753 - RNA, 20 nt, Artificial Sequence
  CIITA targeting sequence
uggugucugcuuuuccuucu

SEQ ID NO: 45754 - RNA, 20 nt, Artificial Sequence
  CIITA targeting sequence
gcuuuuccuucucaagccug

SEQ ID NO: 45755 - RNA, 20 nt, Artificial Sequence
  CIITA targeting sequence
uucucaagccugagcucccu

SEQ ID NO: 45756 - RNA, 20 nt, Artificial Sequence
  CIITA targeting sequence
caagccugagcucccuugac

SEQ ID NO: 45757 - RNA, 20 nt, Artificial Sequence
  CIITA targeting sequence
agccugagcucccuugacag

SEQ ID NO: 45758 - RNA, 20 nt, Artificial Sequence
  CIITA targeting sequence
ggcuugagaaggaaaagcag

SEQ ID NO: 45759 - RNA, 20 nt, Artificial Sequence
  CIITA targeting sequence
cuugacaggugaaguuaccu

SEQ ID NO: 45760 - RNA, 20 nt, Artificial Sequence
  CIITA targeting sequence
agggagcucaggcuugagaa

SEQ ID NO: 45761 - RNA, 20 nt, Artificial Sequence
  CIITA targeting sequence
ccugucaagggagcucaggc

SEQ ID NO: 45762 - RNA, 20 nt, Artificial Sequence
  CIITA targeting sequence
agggcccacagccccaggua

SEQ ID NO: 45763 - RNA, 20 nt, Artificial Sequence
  CIITA targeting sequence
ccagggcccacagccccagg

SEQ ID NO: 45764 - RNA, 20 nt, Artificial Sequence
  CIITA targeting sequence
uaaaagccgugcccgguggc

SEQ ID NO: 45765 - RNA, 20 nt, Artificial Sequence
  CIITA targeting sequence
cagggcauccagcuaggcuu

SEQ ID NO: 45766 - RNA, 20 nt, Artificial Sequence
  CIITA targeting sequence
agcuaggcuucugguccccg

SEQ ID NO: 45767 - RNA, 20 nt, Artificial Sequence
  CIITA targeting sequence
gguccccgcgcugcucagga

SEQ ID NO: 45768 - RNA, 20 nt, Artificial Sequence
  CIITA targeting sequence
ccgcgcugcucaggacuggc

SEQ ID NO: 45769 - RNA, 20 nt, Artificial Sequence
  CIITA targeting sequence
ggacuggccucggugauucu

SEQ ID NO: 45770 - RNA, 20 nt, Artificial Sequence
  CIITA targeting sequence
ugagcagcgcggggaccaga

SEQ ID NO: 45771 - RNA, 20 nt, Artificial Sequence
  CIITA targeting sequence
gugauucuuuuggucucccc

SEQ ID NO: 45772 - RNA, 20 nt, Artificial Sequence
  CIITA targeting sequence
ccgaggccaguccugagcag

SEQ ID NO: 45773 - RNA, 20 nt, Artificial Sequence
  CIITA targeting sequence
uuuggucucccccaccagca

SEQ ID NO: 45774 - RNA, 20 nt, Artificial Sequence
  CIITA targeting sequence
cccccaccagcaaagaggcc

SEQ ID NO: 45775 - RNA, 20 nt, Artificial Sequence
  CIITA targeting sequence
cccaccagcaaagaggccuu

SEQ ID NO: 45776 - RNA, 20 nt, Artificial Sequence
  CIITA targeting sequence
uugcuggugggggagaccaa

SEQ ID NO: 45777 - RNA, 20 nt, Artificial Sequence
  CIITA targeting sequence
aggccucuuugcuggugggg

SEQ ID NO: 45778 - RNA, 20 nt, Artificial Sequence
  CIITA targeting sequence
ucaaggccucuuugcuggug

SEQ ID NO: 45779 - RNA, 20 nt, Artificial Sequence
  CIITA targeting sequence
aguccucaaggccucuuugc

SEQ ID NO: 45780 - RNA, 20 nt, Artificial Sequence
  CIITA targeting sequence
accugucucagcuccagcac

SEQ ID NO: 45781 - RNA, 20 nt, Artificial Sequence
  CIITA targeting sequence
cagcuccagcaccuggcauu

SEQ ID NO: 45782 - RNA, 20 nt, Artificial Sequence
  CIITA targeting sequence
gcuccagcaccuggcauuca

SEQ ID NO: 45783 - RNA, 20 nt, Artificial Sequence
  CIITA targeting sequence
agcaccuggcauucaggccu

SEQ ID NO: 45784 - RNA, 20 nt, Artificial Sequence
  CIITA targeting sequence
ggccuguuuggguagaugaa

SEQ ID NO: 45785 - RNA, 20 nt, Artificial Sequence
  CIITA targeting sequence
acccaaacaggccugaaugc

SEQ ID NO: 45786 - RNA, 20 nt, Artificial Sequence
  CIITA targeting sequence
ucuacccaaacaggccugaa

SEQ ID NO: 45787 - RNA, 20 nt, Artificial Sequence
  CIITA targeting sequence
gcagcccuuauuuauuuauu

SEQ ID NO: 45788 - RNA, 20 nt, Artificial Sequence
  CIITA targeting sequence
aaauaaauaaauaaauaaau

SEQ ID NO: 45789 - RNA, 20 nt, Artificial Sequence
  CIITA targeting sequence
cgcucugucacccaggcugg

SEQ ID NO: 45790 - RNA, 20 nt, Artificial Sequence
  CIITA targeting sequence
cucugucacccaggcuggag

SEQ ID NO: 45791 - RNA, 20 nt, Artificial Sequence
  CIITA targeting sequence
gucacccaggcuggagugca

SEQ ID NO: 45792 - RNA, 20 nt, Artificial Sequence
  CIITA targeting sequence
cccaggcuggagugcaaugg

SEQ ID NO: 45793 - RNA, 20 nt, Artificial Sequence
  CIITA targeting sequence
agccugggugacagagcgag

SEQ ID NO: 45794 - RNA, 20 nt, Artificial Sequence
  CIITA targeting sequence
caccauugcacuccagccug

SEQ ID NO: 45795 - RNA, 20 nt, Artificial Sequence
  CIITA targeting sequence
cggcucacugcaaccuccac

SEQ ID NO: 45796 - RNA, 20 nt, Artificial Sequence
  CIITA targeting sequence
gcucacugcaaccuccaccu

SEQ ID NO: 45797 - RNA, 20 nt, Artificial Sequence
  CIITA targeting sequence
cugcaaccuccaccucccag

SEQ ID NO: 45798 - RNA, 20 nt, Artificial Sequence
  CIITA targeting sequence
accucccagguucaagcaau

SEQ ID NO: 45799 - RNA, 20 nt, Artificial Sequence
  CIITA targeting sequence
cagguucaagcaauucuccc

SEQ ID NO: 45800 - RNA, 20 nt, Artificial Sequence
  CIITA targeting sequence
agcaauucucccugccucag

SEQ ID NO: 45801 - RNA, 20 nt, Artificial Sequence
  CIITA targeting sequence
cccugccucagcuuccagag

SEQ ID NO: 45802 - RNA, 20 nt, Artificial Sequence
  CIITA targeting sequence
cugccucagcuuccagagua

SEQ ID NO: 45803 - RNA, 20 nt, Artificial Sequence
  CIITA targeting sequence
gcuuccagaguagcugggau

SEQ ID NO: 45804 - RNA, 20 nt, Artificial Sequence
  CIITA targeting sequence
agaguagcugggauuacaga

SEQ ID NO: 45805 - RNA, 20 nt, Artificial Sequence
  CIITA targeting sequence
ggaagcugaggcagggagaa

SEQ ID NO: 45806 - RNA, 20 nt, Artificial Sequence
  CIITA targeting sequence
cagcuacucuggaagcugag

SEQ ID NO: 45807 - RNA, 20 nt, Artificial Sequence
  CIITA targeting sequence
guaaucccagcuacucugga

SEQ ID NO: 45808 - RNA, 20 nt, Artificial Sequence
  CIITA targeting sequence
ccaccacacccagcuaaugu

SEQ ID NO: 45809 - RNA, 20 nt, Artificial Sequence
  CIITA targeting sequence
acuaaaaauacaaacauuag

SEQ ID NO: 45810 - RNA, 20 nt, Artificial Sequence
  CIITA targeting sequence
cuacuaaaaauacaaacauu

SEQ ID NO: 45811 - RNA, 20 nt, Artificial Sequence
  CIITA targeting sequence
ccauguugaccaggcugguc

SEQ ID NO: 45812 - RNA, 20 nt, Artificial Sequence
  CIITA targeting sequence
acauggcgaaacccugucuc

SEQ ID NO: 45813 - RNA, 20 nt, Artificial Sequence
  CIITA targeting sequence
ugagcuccugaccucaggug

SEQ ID NO: 45814 - RNA, 20 nt, Artificial Sequence
  CIITA targeting sequence
agaccagccuggucaacaug

SEQ ID NO: 45815 - RNA, 20 nt, Artificial Sequence
  CIITA targeting sequence
ugaccucaggugauccaccc

SEQ ID NO: 45816 - RNA, 20 nt, Artificial Sequence
  CIITA targeting sequence
ggagcucaagaccagccugg

SEQ ID NO: 45817 - RNA, 20 nt, Artificial Sequence
  CIITA targeting sequence
ggugauccacccaccuuggc

SEQ ID NO: 45818 - RNA, 20 nt, Artificial Sequence
  CIITA targeting sequence
ccugaggucaggagcucaag

SEQ ID NO: 45819 - RNA, 20 nt, Artificial Sequence
  CIITA targeting sequence
acccaccuuggccucccaaa

SEQ ID NO: 45820 - RNA, 20 nt, Artificial Sequence
  CIITA targeting sequence
caaagugcugggauuacagg

SEQ ID NO: 45821 - RNA, 20 nt, Artificial Sequence
  CIITA targeting sequence
cagcacuuugggaggccaag

SEQ ID NO: 45822 - RNA, 20 nt, Artificial Sequence
  CIITA targeting sequence
ugccuguaaucccagcacuu

SEQ ID NO: 45823 - RNA, 20 nt, Artificial Sequence
  CIITA targeting sequence
cagccagcccauuuaacuca

SEQ ID NO: 45824 - RNA, 20 nt, Artificial Sequence
  CIITA targeting sequence
gugaauuuaacaaucuguuc

SEQ ID NO: 45825 - RNA, 20 nt, Artificial Sequence
  CIITA targeting sequence
cugaguuaaaugggcuggcu

SEQ ID NO: 45826 - RNA, 20 nt, Artificial Sequence
  CIITA targeting sequence
guucucagcaaauaagacca

SEQ ID NO: 45827 - RNA, 20 nt, Artificial Sequence
  CIITA targeting sequence
cagcaaauaagaccauugcc

SEQ ID NO: 45828 - RNA, 20 nt, Artificial Sequence
  CIITA targeting sequence
gcaaauaagaccauugcccu

SEQ ID NO: 45829 - RNA, 20 nt, Artificial Sequence
  CIITA targeting sequence
uauuugcugagaacagauug

SEQ ID NO: 45830 - RNA, 20 nt, Artificial Sequence
  CIITA targeting sequence
gggugguuugcagcccaagg

SEQ ID NO: 45831 - RNA, 20 nt, Artificial Sequence
  CIITA targeting sequence
uuugagccauaaguucugau

SEQ ID NO: 45832 - RNA, 20 nt, Artificial Sequence
  CIITA targeting sequence
aaugaucugggugguuugca

SEQ ID NO: 45833 - RNA, 20 nt, Artificial Sequence
  CIITA targeting sequence
gaugggcucacugcacuuga

SEQ ID NO: 45834 - RNA, 20 nt, Artificial Sequence
  CIITA targeting sequence
gaacuuauggcucaaaugau

SEQ ID NO: 45835 - RNA, 20 nt, Artificial Sequence
  CIITA targeting sequence
cugcacuugagaaggauugu

SEQ ID NO: 45836 - RNA, 20 nt, Artificial Sequence
  CIITA targeting sequence
agugcagugagcccaucaga

SEQ ID NO: 45837 - RNA, 20 nt, Artificial Sequence
  CIITA targeting sequence
caagugcagugagcccauca

SEQ ID NO: 45838 - RNA, 20 nt, Artificial Sequence
  CIITA targeting sequence
uucucaagugcagugagccc

SEQ ID NO: 45839 - RNA, 20 nt, Artificial Sequence
  CIITA targeting sequence
caauccuucucaagugcagu

SEQ ID NO: 45840 - RNA, 20 nt, Artificial Sequence
  CIITA targeting sequence
aaggggaauugcaugugauu

SEQ ID NO: 45841 - RNA, 20 nt, Artificial Sequence
  CIITA targeting sequence
ccuuggaaugcucacaaucc

SEQ ID NO: 45842 - RNA, 20 nt, Artificial Sequence
  CIITA targeting sequence
caugcaauuccccuuggaau

SEQ ID NO: 45843 - RNA, 20 nt, Artificial Sequence
  CIITA targeting sequence
cagcaacugcugugggaccc

SEQ ID NO: 45844 - RNA, 20 nt, Artificial Sequence
  CIITA targeting sequence
cacagcaguugcugggacaa

SEQ ID NO: 45845 - RNA, 20 nt, Artificial Sequence
  CIITA targeting sequence
uaagcuguggcuccaucucu

SEQ ID NO: 45846 - RNA, 20 nt, Artificial Sequence
  CIITA targeting sequence
aucucucuaaaccucaacau

SEQ ID NO: 45847 - RNA, 20 nt, Artificial Sequence
  CIITA targeting sequence
cucuaaaccucaacauuagc

SEQ ID NO: 45848 - RNA, 20 nt, Artificial Sequence
  CIITA targeting sequence
cuaaaccucaacauuagccu

SEQ ID NO: 45849 - RNA, 20 nt, Artificial Sequence
  CIITA targeting sequence
aaaccucaacauuagccugg

SEQ ID NO: 45850 - RNA, 20 nt, Artificial Sequence
  CIITA targeting sequence
acauuagccuggcugcaggc

SEQ ID NO: 45851 - RNA, 20 nt, Artificial Sequence
  CIITA targeting sequence
agccugagcuguaugucccc

SEQ ID NO: 45852 - RNA, 20 nt, Artificial Sequence
  CIITA targeting sequence
ggcuggaugccuaacacggg

SEQ ID NO: 45853 - RNA, 20 nt, Artificial Sequence
  CIITA targeting sequence
ccacuugcucugaaggcauc

SEQ ID NO: 45854 - RNA, 20 nt, Artificial Sequence
  CIITA targeting sequence
gaaggcaucaacaugauggg

SEQ ID NO: 45855 - RNA, 20 nt, Artificial Sequence
  CIITA targeting sequence
gagcaaguggggacauacag

SEQ ID NO: 45856 - RNA, 20 nt, Artificial Sequence
  CIITA targeting sequence
acaugaugggaagcauauga

SEQ ID NO: 45857 - RNA, 20 nt, Artificial Sequence
  CIITA targeting sequence
uguugaugccuucagagcaa

SEQ ID NO: 45858 - RNA, 20 nt, Artificial Sequence
  CIITA targeting sequence
caucauguugaugccuucag

SEQ ID NO: 45859 - RNA, 20 nt, Artificial Sequence
  CIITA targeting sequence
uaugcuucccaucauguuga

SEQ ID NO: 45860 - RNA, 20 nt, Artificial Sequence
  CIITA targeting sequence
ucucucaguccugcugaauc

SEQ ID NO: 45861 - RNA, 20 nt, Artificial Sequence
  CIITA targeting sequence
cucaguccugcugaaucuga

SEQ ID NO: 45862 - RNA, 20 nt, Artificial Sequence
  CIITA targeting sequence
caguccugcugaaucugaau

SEQ ID NO: 45863 - RNA, 20 nt, Artificial Sequence
  CIITA targeting sequence
guccugcugaaucugaauuu

SEQ ID NO: 45864 - RNA, 20 nt, Artificial Sequence
  CIITA targeting sequence
ugcugaaucugaauuuccga

SEQ ID NO: 45865 - RNA, 20 nt, Artificial Sequence
  CIITA targeting sequence
gcaggacugagagaagagca

SEQ ID NO: 45866 - RNA, 20 nt, Artificial Sequence
  CIITA targeting sequence
gaauuuccgagggggcucca

SEQ ID NO: 45867 - RNA, 20 nt, Artificial Sequence
  CIITA targeting sequence
gauucagcaggacugagaga

SEQ ID NO: 45868 - RNA, 20 nt, Artificial Sequence
  CIITA targeting sequence
gagggggcuccaggagcccc

SEQ ID NO: 45869 - RNA, 20 nt, Artificial Sequence
  CIITA targeting sequence
gaaauucagauucagcagga

SEQ ID NO: 45870 - RNA, 20 nt, Artificial Sequence
  CIITA targeting sequence
aggagcccccacuugauuca

SEQ ID NO: 45871 - RNA, 20 nt, Artificial Sequence
  CIITA targeting sequence
uggagcccccucggaaauuc

SEQ ID NO: 45872 - RNA, 20 nt, Artificial Sequence
  CIITA targeting sequence
agugggggcuccuggagccc

SEQ ID NO: 45873 - RNA, 20 nt, Artificial Sequence
  CIITA targeting sequence
guucuccgggugguucucuu

SEQ ID NO: 45874 - RNA, 20 nt, Artificial Sequence
  CIITA targeting sequence
ccgggugguucucuugcaca

SEQ ID NO: 45875 - RNA, 20 nt, Artificial Sequence
  CIITA targeting sequence
gggugguucucuugcacacu

SEQ ID NO: 45876 - RNA, 20 nt, Artificial Sequence
  CIITA targeting sequence
cuugcacacugcaguuugag

SEQ ID NO: 45877 - RNA, 20 nt, Artificial Sequence
  CIITA targeting sequence
ugcacacugcaguuugagag

SEQ ID NO: 45878 - RNA, 20 nt, Artificial Sequence
  CIITA targeting sequence
aacugcagugugcaagagaa

SEQ ID NO: 45879 - RNA, 20 nt, Artificial Sequence
  CIITA targeting sequence
caaacugcagugugcaagag

SEQ ID NO: 45880 - RNA, 20 nt, Artificial Sequence
  CIITA targeting sequence
acuacucucaaacugcagug

SEQ ID NO: 45881 - RNA, 20 nt, Artificial Sequence
  CIITA targeting sequence
aggguuugacgauuuucuug

SEQ ID NO: 45882 - RNA, 20 nt, Artificial Sequence
  CIITA targeting sequence
aacccuugaagucaacuacu

SEQ ID NO: 45883 - RNA, 20 nt, Artificial Sequence
  CIITA targeting sequence
ucaaacccuugaagucaacu

SEQ ID NO: 45884 - RNA, 20 nt, Artificial Sequence
  CIITA targeting sequence
ugucuccgucuggguuggug

SEQ ID NO: 45885 - RNA, 20 nt, Artificial Sequence
  CIITA targeting sequence
ccgucuggguuggugugucc

SEQ ID NO: 45886 - RNA, 20 nt, Artificial Sequence
  CIITA targeting sequence
gucuggguugguguguccuu

SEQ ID NO: 45887 - RNA, 20 nt, Artificial Sequence
  CIITA targeting sequence
ggguugguguguccuugguu

SEQ ID NO: 45888 - RNA, 20 nt, Artificial Sequence
  CIITA targeting sequence
uugguuuaacccuucaaagc

SEQ ID NO: 45889 - RNA, 20 nt, Artificial Sequence
  CIITA targeting sequence
aagcauugucugcuauuuuu

SEQ ID NO: 45890 - RNA, 20 nt, Artificial Sequence
  CIITA targeting sequence
gcuauuuuucugggguugug

SEQ ID NO: 45891 - RNA, 20 nt, Artificial Sequence
  CIITA targeting sequence
gggguugugaguuacaucua

SEQ ID NO: 45892 - RNA, 20 nt, Artificial Sequence
  CIITA targeting sequence
caaccccagaaaaauagcag

SEQ ID NO: 45893 - RNA, 20 nt, Artificial Sequence
  CIITA targeting sequence
aaucugaaugggaaauugca

SEQ ID NO: 45894 - RNA, 20 nt, Artificial Sequence
  CIITA targeting sequence
gaaugggaaauugcauuacc

SEQ ID NO: 45895 - RNA, 20 nt, Artificial Sequence
  CIITA targeting sequence
gauuagauguaacucacaac

SEQ ID NO: 45896 - RNA, 20 nt, Artificial Sequence
  CIITA targeting sequence
cauucagauuagauguaacu

SEQ ID NO: 45897 - RNA, 20 nt, Artificial Sequence
  CIITA targeting sequence
gguuuggguaaugcaauuuc

SEQ ID NO: 45898 - RNA, 20 nt, Artificial Sequence
  CIITA targeting sequence
ccaaaauauugcuaaugguc

SEQ ID NO: 45899 - RNA, 20 nt, Artificial Sequence
  CIITA targeting sequence
aaaauauugcuaauggucau

SEQ ID NO: 45900 - RNA, 20 nt, Artificial Sequence
  CIITA targeting sequence
uggaacuuggcuugcauuuc

SEQ ID NO: 45901 - RNA, 20 nt, Artificial Sequence
  CIITA targeting sequence
augaccauuagcaauauuuu

SEQ ID NO: 45902 - RNA, 20 nt, Artificial Sequence
  CIITA targeting sequence
guugguaaccuuuaauuucc

SEQ ID NO: 45903 - RNA, 20 nt, Artificial Sequence
  CIITA targeting sequence
uuuucucucauuucucucag

SEQ ID NO: 45904 - RNA, 20 nt, Artificial Sequence
  CIITA targeting sequence
cucauuucucucagguaucu

SEQ ID NO: 45905 - RNA, 20 nt, Artificial Sequence
  CIITA targeting sequence
cauuucucucagguaucugu

SEQ ID NO: 45906 - RNA, 20 nt, Artificial Sequence
  CIITA targeting sequence
uuucucucagguaucuguac

SEQ ID NO: 45907 - RNA, 20 nt, Artificial Sequence
  CIITA targeting sequence
cucagguaucuguaccacgu

SEQ ID NO: 45908 - RNA, 20 nt, Artificial Sequence
  CIITA targeting sequence
cagguaucuguaccacguuu

SEQ ID NO: 45909 - RNA, 20 nt, Artificial Sequence
  CIITA targeting sequence
gguaucuguaccacguuuug

SEQ ID NO: 45910 - RNA, 20 nt, Artificial Sequence
  CIITA targeting sequence
guaccacguuuugaccaaaa

SEQ ID NO: 45911 - RNA, 20 nt, Artificial Sequence
  CIITA targeting sequence
aaacgugguacagauaccug

SEQ ID NO: 45912 - RNA, 20 nt, Artificial Sequence
  CIITA targeting sequence
cagaacagaaccggaaccug

SEQ ID NO: 45913 - RNA, 20 nt, Artificial Sequence
  CIITA targeting sequence
gugacugugguguuuuuggu

SEQ ID NO: 45914 - RNA, 20 nt, Artificial Sequence
  CIITA targeting sequence
guucugugacugugguguuu

SEQ ID NO: 45915 - RNA, 20 nt, Artificial Sequence
  CIITA targeting sequence
gguucuguucugugacugug

SEQ ID NO: 45916 - RNA, 20 nt, Artificial Sequence
  CIITA targeting sequence
acuagcagguuccgguucug

SEQ ID NO: 45917 - RNA, 20 nt, Artificial Sequence
  CIITA targeting sequence
ccacuagcagguuccgguuc

SEQ ID NO: 45918 - RNA, 20 nt, Artificial Sequence
  CIITA targeting sequence
guuccaucacugagauccug

SEQ ID NO: 45919 - RNA, 20 nt, Artificial Sequence
  CIITA targeting sequence
aucacugagauccugaucug

SEQ ID NO: 45920 - RNA, 20 nt, Artificial Sequence
  CIITA targeting sequence
cugagauccugaucugggga

SEQ ID NO: 45921 - RNA, 20 nt, Artificial Sequence
  CIITA targeting sequence
gugauggaacggauggucuc

SEQ ID NO: 45922 - RNA, 20 nt, Artificial Sequence
  CIITA targeting sequence
cagugauggaacggaugguc

SEQ ID NO: 45923 - RNA, 20 nt, Artificial Sequence
  CIITA targeting sequence
ugaucuggggagaucaaaau

SEQ ID NO: 45924 - RNA, 20 nt, Artificial Sequence
  CIITA targeting sequence
ggaucucagugauggaacgg

SEQ ID NO: 45925 - RNA, 20 nt, Artificial Sequence
  CIITA targeting sequence
ggggagaucaaaaugacagc

SEQ ID NO: 45926 - RNA, 20 nt, Artificial Sequence
  CIITA targeting sequence
ccagaucaggaucucaguga

SEQ ID NO: 45927 - RNA, 20 nt, Artificial Sequence
  CIITA targeting sequence
ccccagaucaggaucucagu

SEQ ID NO: 45928 - RNA, 20 nt, Artificial Sequence
  CIITA targeting sequence
aaaugacagcucuguauuug

SEQ ID NO: 45929 - RNA, 20 nt, Artificial Sequence
  CIITA targeting sequence
uuuugaucuccccagaucag

SEQ ID NO: 45930 - RNA, 20 nt, Artificial Sequence
  CIITA targeting sequence
guauuugaguaaggguuucu

SEQ ID NO: 45931 - RNA, 20 nt, Artificial Sequence
  CIITA targeting sequence
aauacagagcugucauuuug

SEQ ID NO: 45932 - RNA, 20 nt, Artificial Sequence
  CIITA targeting sequence
aaugauugcuguucuuugau

SEQ ID NO: 45933 - RNA, 20 nt, Artificial Sequence
  CIITA targeting sequence
uuagaaacccuuacucaaau

SEQ ID NO: 45934 - RNA, 20 nt, Artificial Sequence
  CIITA targeting sequence
uugauuauucuucuuugaau

SEQ ID NO: 45935 - RNA, 20 nt, Artificial Sequence
  CIITA targeting sequence
aagaacagcaaucauuagaa

SEQ ID NO: 45936 - RNA, 20 nt, Artificial Sequence
  CIITA targeting sequence
ucuuugaauguuuuucuaaa

SEQ ID NO: 45937 - RNA, 20 nt, Artificial Sequence
  CIITA targeting sequence
uugaauguuuuucuaaaugu

SEQ ID NO: 45938 - RNA, 20 nt, Artificial Sequence
  CIITA targeting sequence
aagaagaauaaucaaagaac

SEQ ID NO: 45939 - RNA, 20 nt, Artificial Sequence
  CIITA targeting sequence
aaauguauacuaugagucau

SEQ ID NO: 45940 - RNA, 20 nt, Artificial Sequence
  CIITA targeting sequence
uaguauacauuuagaaaaac

SEQ ID NO: 45941 - RNA, 20 nt, Artificial Sequence
  CIITA targeting sequence
uucuggaugaugucaggauu

SEQ ID NO: 45942 - RNA, 20 nt, Artificial Sequence
  CIITA targeting sequence
ggaugaugucaggauuugac

SEQ ID NO: 45943 - RNA, 20 nt, Artificial Sequence
  CIITA targeting sequence
agaaugacucauaguauaca

SEQ ID NO: 45944 - RNA, 20 nt, Artificial Sequence
  CIITA targeting sequence
uccagaaugacucauaguau

SEQ ID NO: 45945 - RNA, 20 nt, Artificial Sequence
  CIITA targeting sequence
ggauuugacgcuaauuugau

SEQ ID NO: 45946 - RNA, 20 nt, Artificial Sequence
  CIITA targeting sequence
ugacaucauccagaaugacu

SEQ ID NO: 45947 - RNA, 20 nt, Artificial Sequence
  CIITA targeting sequence
aauccugacaucauccagaa

SEQ ID NO: 45948 - RNA, 20 nt, Artificial Sequence
  CIITA targeting sequence
aauuagcgucaaauccugac

SEQ ID NO: 45949 - RNA, 20 nt, Artificial Sequence
  CIITA targeting sequence
ugccuagauaucuaucucug

SEQ ID NO: 45950 - RNA, 20 nt, Artificial Sequence
  CIITA targeting sequence
aggcaagaucaaauuagcgu

SEQ ID NO: 45951 - RNA, 20 nt, Artificial Sequence
  CIITA targeting sequence
aucucugucuagcuguaaaa

SEQ ID NO: 45952 - RNA, 20 nt, Artificial Sequence
  CIITA targeting sequence
cugucuagcuguaaaaaaaa

SEQ ID NO: 45953 - RNA, 20 nt, Artificial Sequence
  CIITA targeting sequence
gucuagcuguaaaaaaaaaa

SEQ ID NO: 45954 - RNA, 20 nt, Artificial Sequence
  CIITA targeting sequence
agcuguaaaaaaaaaaaaaa

SEQ ID NO: 45955 - RNA, 20 nt, Artificial Sequence
  CIITA targeting sequence
agggcauuuuuuuuuuuuuu

SEQ ID NO: 45956 - RNA, 20 nt, Artificial Sequence
  CIITA targeting sequence
auagugcuucaagggcauuu

SEQ ID NO: 45957 - RNA, 20 nt, Artificial Sequence
  CIITA targeting sequence
ccauuuuuggcuugcauuuc

SEQ ID NO: 45958 - RNA, 20 nt, Artificial Sequence
  CIITA targeting sequence
auaacuuccccauuuuuggc

SEQ ID NO: 45959 - RNA, 20 nt, Artificial Sequence
  CIITA targeting sequence
uuuccauaacuuccccauuu

SEQ ID NO: 45960 - RNA, 20 nt, Artificial Sequence
  CIITA targeting sequence
cuagaaaaccugaaaauguc

SEQ ID NO: 45961 - RNA, 20 nt, Artificial Sequence
  CIITA targeting sequence
agaaaaccugaaaaugucau

SEQ ID NO: 45962 - RNA, 20 nt, Artificial Sequence
  CIITA targeting sequence
agagacacucauuuccauaa

SEQ ID NO: 45963 - RNA, 20 nt, Artificial Sequence
  CIITA targeting sequence
gguuuucuagagacacucau

SEQ ID NO: 45964 - RNA, 20 nt, Artificial Sequence
  CIITA targeting sequence
uggguaauuuuccuucaggu

SEQ ID NO: 45965 - RNA, 20 nt, Artificial Sequence
  CIITA targeting sequence
uucagguugugucugauuau

SEQ ID NO: 45966 - RNA, 20 nt, Artificial Sequence
  CIITA targeting sequence
gguugugucugauuauuuuc

SEQ ID NO: 45967 - RNA, 20 nt, Artificial Sequence
  CIITA targeting sequence
gauuauuuucccaaaggaag

SEQ ID NO: 45968 - RNA, 20 nt, Artificial Sequence
  CIITA targeting sequence
gacacaaccugaaggaaaau

SEQ ID NO: 45969 - RNA, 20 nt, Artificial Sequence
  CIITA targeting sequence
caaaggaaggagaacauguc

SEQ ID NO: 45970 - RNA, 20 nt, Artificial Sequence
  CIITA targeting sequence
uuugggaaaauaaucagaca

SEQ ID NO: 45971 - RNA, 20 nt, Artificial Sequence
  CIITA targeting sequence
uuccuuugggaaaauaauca

SEQ ID NO: 45972 - RNA, 20 nt, Artificial Sequence
  CIITA targeting sequence
ccuuccuuugggaaaauaau

SEQ ID NO: 45973 - RNA, 20 nt, Artificial Sequence
  CIITA targeting sequence
ggugguuagauuugacauga

SEQ ID NO: 45974 - RNA, 20 nt, Artificial Sequence
  CIITA targeting sequence
aaccaccagacauguucucc

SEQ ID NO: 45975 - RNA, 20 nt, Artificial Sequence
  CIITA targeting sequence
aaucuaaccaccagacaugu

SEQ ID NO: 45976 - RNA, 20 nt, Artificial Sequence
  CIITA targeting sequence
ugucaaaucuaaccaccaga

SEQ ID NO: 45977 - RNA, 20 nt, Artificial Sequence
  CIITA targeting sequence
guucaugucaaaucuaacca

SEQ ID NO: 45978 - RNA, 20 nt, Artificial Sequence
  CIITA targeting sequence
cccagggcacaggccuucug

SEQ ID NO: 45979 - RNA, 20 nt, Artificial Sequence
  CIITA targeting sequence
cugagggcucccaguuacca

SEQ ID NO: 45980 - RNA, 20 nt, Artificial Sequence
  CIITA targeting sequence
gggacucccccagggcacag

SEQ ID NO: 45981 - RNA, 20 nt, Artificial Sequence
  CIITA targeting sequence
caguuaccauguuuacugau

SEQ ID NO: 45982 - RNA, 20 nt, Artificial Sequence
  CIITA targeting sequence
guaaacaugguaacugggag

SEQ ID NO: 45983 - RNA, 20 nt, Artificial Sequence
  CIITA targeting sequence
ucaguaaacaugguaacugg

SEQ ID NO: 45984 - RNA, 20 nt, Artificial Sequence
  CIITA targeting sequence
gcccugugccuggucaucag

SEQ ID NO: 45985 - RNA, 20 nt, Artificial Sequence
  CIITA targeting sequence
ugaugagaugguccaccuaa

SEQ ID NO: 45986 - RNA, 20 nt, Artificial Sequence
  CIITA targeting sequence
ggagcucagcccugugccug

SEQ ID NO: 45987 - RNA, 20 nt, Artificial Sequence
  CIITA targeting sequence
ucaggagcucagcccugugc

SEQ ID NO: 45988 - RNA, 20 nt, Artificial Sequence
  CIITA targeting sequence
caucaggagcucagcccugu

SEQ ID NO: 45989 - RNA, 20 nt, Artificial Sequence
  CIITA targeting sequence
accuaaguuucccacccacc

SEQ ID NO: 45990 - RNA, 20 nt, Artificial Sequence
  CIITA targeting sequence
cacccaccccaugguagagg

SEQ ID NO: 45991 - RNA, 20 nt, Artificial Sequence
  CIITA targeting sequence
accauggggugggugggaaa

SEQ ID NO: 45992 - RNA, 20 nt, Artificial Sequence
  CIITA targeting sequence
ccuuuuuugcucaaggucac

SEQ ID NO: 45993 - RNA, 20 nt, Artificial Sequence
  CIITA targeting sequence
aggucacauagcugguaagc

SEQ ID NO: 45994 - RNA, 20 nt, Artificial Sequence
  CIITA targeting sequence
cauagcugguaagcggugga

SEQ ID NO: 45995 - RNA, 20 nt, Artificial Sequence
  CIITA targeting sequence
accgcuuaccagcuauguga

SEQ ID NO: 45996 - RNA, 20 nt, Artificial Sequence
  CIITA targeting sequence
cuuuuccaccgcuuaccagc

SEQ ID NO: 45997 - RNA, 20 nt, Artificial Sequence
  CIITA targeting sequence
gggugugucacuuuuccacc

SEQ ID NO: 45998 - RNA, 20 nt, Artificial Sequence
  CIITA targeting sequence
gugaggggucccgcaacuca

SEQ ID NO: 45999 - RNA, 20 nt, Artificial Sequence
  CIITA targeting sequence
cugauucugggugugucacu

SEQ ID NO: 46000 - RNA, 20 nt, Artificial Sequence
  CIITA targeting sequence
cgcaacucaccacuuccuag

SEQ ID NO: 46001 - RNA, 20 nt, Artificial Sequence
  CIITA targeting sequence
ccacuuccuaggugagcagu

SEQ ID NO: 46002 - RNA, 20 nt, Artificial Sequence
  CIITA targeting sequence
uaggugagcaguccucagcc

SEQ ID NO: 46003 - RNA, 20 nt, Artificial Sequence
  CIITA targeting sequence
ccuaggaaguggugaguugc

SEQ ID NO: 46004 - RNA, 20 nt, Artificial Sequence
  CIITA targeting sequence
ucagccaggcucuucaucuc

SEQ ID NO: 46005 - RNA, 20 nt, Artificial Sequence
  CIITA targeting sequence
gccaggcucuucaucucccu

SEQ ID NO: 46006 - RNA, 20 nt, Artificial Sequence
  CIITA targeting sequence
ucaucucccuaagccucagu

SEQ ID NO: 46007 - RNA, 20 nt, Artificial Sequence
  CIITA targeting sequence
ucucccuaagccucaguuuc

SEQ ID NO: 46008 - RNA, 20 nt, Artificial Sequence
  CIITA targeting sequence
cccuaagccucaguuucuuu

SEQ ID NO: 46009 - RNA, 20 nt, Artificial Sequence
  CIITA targeting sequence
cuaagccucaguuucuuuac

SEQ ID NO: 46010 - RNA, 20 nt, Artificial Sequence
  CIITA targeting sequence
guuucuuuaccuuuaaaaga

SEQ ID NO: 46011 - RNA, 20 nt, Artificial Sequence
  CIITA targeting sequence
uuaccuuuaaaagagagaga

SEQ ID NO: 46012 - RNA, 20 nt, Artificial Sequence
  CIITA targeting sequence
uuuaaagguaaagaaacuga

SEQ ID NO: 46013 - RNA, 20 nt, Artificial Sequence
  CIITA targeting sequence
cuuuuaaagguaaagaaacu

SEQ ID NO: 46014 - RNA, 20 nt, Artificial Sequence
  CIITA targeting sequence
cucuuuuaaagguaaagaaa

SEQ ID NO: 46015 - RNA, 20 nt, Artificial Sequence
  CIITA targeting sequence
cucucuuuuaaagguaaaga

SEQ ID NO: 46016 - RNA, 20 nt, Artificial Sequence
  CIITA targeting sequence
cuuugucuagugccugguac

SEQ ID NO: 46017 - RNA, 20 nt, Artificial Sequence
  CIITA targeting sequence
uugucuagugccugguacag

SEQ ID NO: 46018 - RNA, 20 nt, Artificial Sequence
  CIITA targeting sequence
agugccugguacaggaauaa

SEQ ID NO: 46019 - RNA, 20 nt, Artificial Sequence
  CIITA targeting sequence
uguaccaggcacuagacaaa

SEQ ID NO: 46020 - RNA, 20 nt, Artificial Sequence
  CIITA targeting sequence
uuuauuccuguaccaggcac

SEQ ID NO: 46021 - RNA, 20 nt, Artificial Sequence
  CIITA targeting sequence
uuugcuaucauuuauuccug

SEQ ID NO: 46022 - RNA, 20 nt, Artificial Sequence
  CIITA targeting sequence
uuaucauuugcuaucauuua

SEQ ID NO: 46023 - RNA, 20 nt, Artificial Sequence
  CIITA targeting sequence
gucuuuaucauuugcuauca

SEQ ID NO: 46024 - RNA, 20 nt, Artificial Sequence
  CIITA targeting sequence
cuggacaguuaaaaagcaag

SEQ ID NO: 46025 - RNA, 20 nt, Artificial Sequence
  CIITA targeting sequence
agugaggcacgucugucuuu

SEQ ID NO: 46026 - RNA, 20 nt, Artificial Sequence
  CIITA targeting sequence
caccuguaaucccagcacuu

SEQ ID NO: 46027 - RNA, 20 nt, Artificial Sequence
  CIITA targeting sequence
cagcacuuugggaggcugag

SEQ ID NO: 46028 - RNA, 20 nt, Artificial Sequence
  CIITA targeting sequence
caaagugcugggauuacagg

SEQ ID NO: 46029 - RNA, 20 nt, Artificial Sequence
  CIITA targeting sequence
gccucccaaagugcugggau

SEQ ID NO: 46030 - RNA, 20 nt, Artificial Sequence
  CIITA targeting sequence
ugccucagccucccaaagug

SEQ ID NO: 46031 - RNA, 20 nt, Artificial Sequence
  CIITA targeting sequence
uccugccucagccucccaaa

SEQ ID NO: 46032 - RNA, 20 nt, Artificial Sequence
  CIITA targeting sequence
cuugagcccaggaguuugag

SEQ ID NO: 46033 - RNA, 20 nt, Artificial Sequence
  CIITA targeting sequence
agcgauccuccugccucagc

SEQ ID NO: 46034 - RNA, 20 nt, Artificial Sequence
  CIITA targeting sequence
ugggcucaagcgauccuccu

SEQ ID NO: 46035 - RNA, 20 nt, Artificial Sequence
  CIITA targeting sequence
aacuccugggcucaagcgau

SEQ ID NO: 46036 - RNA, 20 nt, Artificial Sequence
  CIITA targeting sequence
caaacuccugggcucaagcg

SEQ ID NO: 46037 - RNA, 20 nt, Artificial Sequence
  CIITA targeting sequence
guauguugcccaggcugguc

SEQ ID NO: 46038 - RNA, 20 nt, Artificial Sequence
  CIITA targeting sequence
cuguauguugcccaggcugg

SEQ ID NO: 46039 - RNA, 20 nt, Artificial Sequence
  CIITA targeting sequence
ucucuacguauaauuaaaaa

SEQ ID NO: 46040 - RNA, 20 nt, Artificial Sequence
  CIITA targeting sequence
cuacguauaauuaaaaaauu

SEQ ID NO: 46041 - RNA, 20 nt, Artificial Sequence
  CIITA targeting sequence
acguauaauuaaaaaauuag

SEQ ID NO: 46042 - RNA, 20 nt, Artificial Sequence
  CIITA targeting sequence
ugcaugguugugugugccug

SEQ ID NO: 46043 - RNA, 20 nt, Artificial Sequence
  CIITA targeting sequence
cagcuacucagaagguugag

SEQ ID NO: 46044 - RNA, 20 nt, Artificial Sequence
  CIITA targeting sequence
gaagguugaggugggaggau

SEQ ID NO: 46045 - RNA, 20 nt, Artificial Sequence
  CIITA targeting sequence
gaguagcugggaacacaggc

SEQ ID NO: 46046 - RNA, 20 nt, Artificial Sequence
  CIITA targeting sequence
accuucugaguagcugggaa

SEQ ID NO: 46047 - RNA, 20 nt, Artificial Sequence
  CIITA targeting sequence
caccucaaccuucugaguag

SEQ ID NO: 46048 - RNA, 20 nt, Artificial Sequence
  CIITA targeting sequence
ucccaccucaaccuucugag

SEQ ID NO: 46049 - RNA, 20 nt, Artificial Sequence
  CIITA targeting sequence
ggcaauccucccaccucaac

SEQ ID NO: 46050 - RNA, 20 nt, Artificial Sequence
  CIITA targeting sequence
ugggcucaggcaauccuccc

SEQ ID NO: 46051 - RNA, 20 nt, Artificial Sequence
  CIITA targeting sequence
aggcugcaaugagccaugau

SEQ ID NO: 46052 - RNA, 20 nt, Artificial Sequence
  CIITA targeting sequence
uugcagccuggaccuccugg

SEQ ID NO: 46053 - RNA, 20 nt, Artificial Sequence
  CIITA targeting sequence
uggcucauugcagccuggac

SEQ ID NO: 46054 - RNA, 20 nt, Artificial Sequence
  CIITA targeting sequence
ugccacugcacuccagccug

SEQ ID NO: 46055 - RNA, 20 nt, Artificial Sequence
  CIITA targeting sequence
agccugggugacagagugag

SEQ ID NO: 46056 - RNA, 20 nt, Artificial Sequence
  CIITA targeting sequence
cccaggcuggagugcagugg

SEQ ID NO: 46057 - RNA, 20 nt, Artificial Sequence
  CIITA targeting sequence
gucacccaggcuggagugca

SEQ ID NO: 46058 - RNA, 20 nt, Artificial Sequence
  CIITA targeting sequence
cucugucacccaggcuggag

SEQ ID NO: 46059 - RNA, 20 nt, Artificial Sequence
  CIITA targeting sequence
cacucugucacccaggcugg

SEQ ID NO: 46060 - RNA, 20 nt, Artificial Sequence
  CIITA targeting sequence
caaaaaaaaaauagcaaggg

SEQ ID NO: 46061 - RNA, 20 nt, Artificial Sequence
  CIITA targeting sequence
aaaaaaaaauagcaagggcu

SEQ ID NO: 46062 - RNA, 20 nt, Artificial Sequence
  CIITA targeting sequence
caguuaacagcccuugcuau

SEQ ID NO: 46063 - RNA, 20 nt, Artificial Sequence
  CIITA targeting sequence
cuaauagaucugccuugaug

SEQ ID NO: 46064 - RNA, 20 nt, Artificial Sequence
  CIITA targeting sequence
auuagggagguaguucacag

SEQ ID NO: 46065 - RNA, 20 nt, Artificial Sequence
  CIITA targeting sequence
gccuugaugucuuagugcag

SEQ ID NO: 46066 - RNA, 20 nt, Artificial Sequence
  CIITA targeting sequence
aggcagaucuauuagggagg

SEQ ID NO: 46067 - RNA, 20 nt, Artificial Sequence
  CIITA targeting sequence
uagugcagaaggauuugggg

SEQ ID NO: 46068 - RNA, 20 nt, Artificial Sequence
  CIITA targeting sequence
gcacuaagacaucaaggcag

SEQ ID NO: 46069 - RNA, 20 nt, Artificial Sequence
  CIITA targeting sequence
uucugcacuaagacaucaag

SEQ ID NO: 46070 - RNA, 20 nt, Artificial Sequence
  CIITA targeting sequence
uaacccagccccaaauccuu

SEQ ID NO: 46071 - RNA, 20 nt, Artificial Sequence
  CIITA targeting sequence
guauuauaaauauugaggcc

SEQ ID NO: 46072 - RNA, 20 nt, Artificial Sequence
  CIITA targeting sequence
auauuuauaauacagacaca

SEQ ID NO: 46073 - RNA, 20 nt, Artificial Sequence
  CIITA targeting sequence
uuuuugaaaaguaaaagugu

SEQ ID NO: 46074 - RNA, 20 nt, Artificial Sequence
  CIITA targeting sequence
aaaaugaguuuuaaaagugg

SEQ ID NO: 46075 - RNA, 20 nt, Artificial Sequence
  CIITA targeting sequence
auuuuuaaccugguuucuua

SEQ ID NO: 46076 - RNA, 20 nt, Artificial Sequence
  CIITA targeting sequence
uauuagauauccgaauaaga

SEQ ID NO: 46077 - RNA, 20 nt, Artificial Sequence
  CIITA targeting sequence
aauaagaaaccagguuaaaa

SEQ ID NO: 46078 - RNA, 20 nt, Artificial Sequence
  CIITA targeting sequence
gaauaagaaggauauuaccu

SEQ ID NO: 46079 - RNA, 20 nt, Artificial Sequence
  CIITA targeting sequence
gauaucuaauaagaaaccag

SEQ ID NO: 46080 - RNA, 20 nt, Artificial Sequence
  CIITA targeting sequence
uauucggauaucuaauaaga

SEQ ID NO: 46081 - RNA, 20 nt, Artificial Sequence
  CIITA targeting sequence
uucuuauucggauaucuaau

SEQ ID NO: 46082 - RNA, 20 nt, Artificial Sequence
  CIITA targeting sequence
uggauucagacagaauuagg

SEQ ID NO: 46083 - RNA, 20 nt, Artificial Sequence
  CIITA targeting sequence
augaaaagguaauauccuuc

SEQ ID NO: 46084 - RNA, 20 nt, Artificial Sequence
  CIITA targeting sequence
gacagaauuaggcagcacug

SEQ ID NO: 46085 - RNA, 20 nt, Artificial Sequence
  CIITA targeting sequence
gaauccaugaaaagguaaua

SEQ ID NO: 46086 - RNA, 20 nt, Artificial Sequence
  CIITA targeting sequence
gucugaauccaugaaaaggu

SEQ ID NO: 46087 - RNA, 20 nt, Artificial Sequence
  CIITA targeting sequence
gugcugccuaauucugucug

SEQ ID NO: 46088 - RNA, 20 nt, Artificial Sequence
  CIITA targeting sequence
ugaauauagguucaggguag

SEQ ID NO: 46089 - RNA, 20 nt, Artificial Sequence
  CIITA targeting sequence
ggaacuugcucagugcugcc

SEQ ID NO: 46090 - RNA, 20 nt, Artificial Sequence
  CIITA targeting sequence
ggguagcuuuauauuuucau

SEQ ID NO: 46091 - RNA, 20 nt, Artificial Sequence
  CIITA targeting sequence
ucagcaagguuauccaauaa

SEQ ID NO: 46092 - RNA, 20 nt, Artificial Sequence
  CIITA targeting sequence
gcaagguuauccaauaaagc

SEQ ID NO: 46093 - RNA, 20 nt, Artificial Sequence
  CIITA targeting sequence
aauaaagcuacuuguggaaa

SEQ ID NO: 46094 - RNA, 20 nt, Artificial Sequence
  CIITA targeting sequence
acaaguagcuuuauuggaua

SEQ ID NO: 46095 - RNA, 20 nt, Artificial Sequence
  CIITA targeting sequence
gcauuuccacaaguagcuuu

SEQ ID NO: 46096 - RNA, 20 nt, Artificial Sequence
  CIITA targeting sequence
uuaaaaugcaaaccuguaaa

SEQ ID NO: 46097 - RNA, 20 nt, Artificial Sequence
  CIITA targeting sequence
uagccacuguuuacagguuu

SEQ ID NO: 46098 - RNA, 20 nt, Artificial Sequence
  CIITA targeting sequence
ccaaagcagaacaugcgagu

SEQ ID NO: 46099 - RNA, 20 nt, Artificial Sequence
  CIITA targeting sequence
aaagcagaacaugcgaguca

SEQ ID NO: 46100 - RNA, 20 nt, Artificial Sequence
  CIITA targeting sequence
gcuuuggagaucauagccac

SEQ ID NO: 46101 - RNA, 20 nt, Artificial Sequence
  CIITA targeting sequence
cauguucugcuuuggagauc

SEQ ID NO: 46102 - RNA, 20 nt, Artificial Sequence
  CIITA targeting sequence
ugaauuuguguuuauauaca

SEQ ID NO: 46103 - RNA, 20 nt, Artificial Sequence
  CIITA targeting sequence
ugacucgcauguucugcuuu

SEQ ID NO: 46104 - RNA, 20 nt, Artificial Sequence
  CIITA targeting sequence
guauauaaacacaaauucau

SEQ ID NO: 46105 - RNA, 20 nt, Artificial Sequence
  CIITA targeting sequence
uuuaaggauccauggggaau

SEQ ID NO: 46106 - RNA, 20 nt, Artificial Sequence
  CIITA targeting sequence
uuaaaggaacuaggucugua

SEQ ID NO: 46107 - RNA, 20 nt, Artificial Sequence
  CIITA targeting sequence
auggggaauuuuguuuuuuu

SEQ ID NO: 46108 - RNA, 20 nt, Artificial Sequence
  CIITA targeting sequence
ccauggauccuuaaaggaac

SEQ ID NO: 46109 - RNA, 20 nt, Artificial Sequence
  CIITA targeting sequence
caaaacaaaaaaaacaaaau

SEQ ID NO: 46110 - RNA, 20 nt, Artificial Sequence
  CIITA targeting sequence
cacaaaacaaaaaaaacaaa

SEQ ID NO: 46111 - RNA, 20 nt, Artificial Sequence
  CIITA targeting sequence
aucucacaaaacaaaaaaaa

SEQ ID NO: 46112 - RNA, 20 nt, Artificial Sequence
  CIITA targeting sequence
ugcucugucauccaggcugg

SEQ ID NO: 46113 - RNA, 20 nt, Artificial Sequence
  CIITA targeting sequence
gucauccaggcuggagugca

SEQ ID NO: 46114 - RNA, 20 nt, Artificial Sequence
  CIITA targeting sequence
uccaggcuggagugcauugg

SEQ ID NO: 46115 - RNA, 20 nt, Artificial Sequence
  CIITA targeting sequence
aggcuggagugcauuggcgg

SEQ ID NO: 46116 - RNA, 20 nt, Artificial Sequence
  CIITA targeting sequence
agccuggaugacagagcaag

SEQ ID NO: 46117 - RNA, 20 nt, Artificial Sequence
  CIITA targeting sequence
cgccaaugcacuccagccug

SEQ ID NO: 46118 - RNA, 20 nt, Artificial Sequence
  CIITA targeting sequence
cggcucaccgcaaccucugc

SEQ ID NO: 46119 - RNA, 20 nt, Artificial Sequence
  CIITA targeting sequence
ccgcaaccucugccucccag

SEQ ID NO: 46120 - RNA, 20 nt, Artificial Sequence
  CIITA targeting sequence
gccucccaguuucaagcaau

SEQ ID NO: 46121 - RNA, 20 nt, Artificial Sequence
  CIITA targeting sequence
caguuucaagcaauucuccu

SEQ ID NO: 46122 - RNA, 20 nt, Artificial Sequence
  CIITA targeting sequence
agcaauucuccuaccucagc

SEQ ID NO: 46123 - RNA, 20 nt, Artificial Sequence
  CIITA targeting sequence
ccuaccucagccucuggagu

SEQ ID NO: 46124 - RNA, 20 nt, Artificial Sequence
  CIITA targeting sequence
uaccucagccucuggaguag

SEQ ID NO: 46125 - RNA, 20 nt, Artificial Sequence
  CIITA targeting sequence
gccucuggaguaguugggau

SEQ ID NO: 46126 - RNA, 20 nt, Artificial Sequence
  CIITA targeting sequence
ggaguaguugggauuacagg

SEQ ID NO: 46127 - RNA, 20 nt, Artificial Sequence
  CIITA targeting sequence
agaggcugagguaggagaau

SEQ ID NO: 46128 - RNA, 20 nt, Artificial Sequence
  CIITA targeting sequence
caacuacuccagaggcugag

SEQ ID NO: 46129 - RNA, 20 nt, Artificial Sequence
  CIITA targeting sequence
acuaaaaauacaaaaauuag

SEQ ID NO: 46130 - RNA, 20 nt, Artificial Sequence
  CIITA targeting sequence
cuacuaaaaauacaaaaauu

SEQ ID NO: 46131 - RNA, 20 nt, Artificial Sequence
  CIITA targeting sequence
ccauguuggccaggcugguc

SEQ ID NO: 46132 - RNA, 20 nt, Artificial Sequence
  CIITA targeting sequence
caaacuccugaccucaggug

SEQ ID NO: 46133 - RNA, 20 nt, Artificial Sequence
  CIITA targeting sequence
aacuccugaccucaggugau

SEQ ID NO: 46134 - RNA, 20 nt, Artificial Sequence
  CIITA targeting sequence
ugaccucaggugauccacca

SEQ ID NO: 46135 - RNA, 20 nt, Artificial Sequence
  CIITA targeting sequence
ggaguuugagaccagccugg

SEQ ID NO: 46136 - RNA, 20 nt, Artificial Sequence
  CIITA targeting sequence
ggugauccaccagccucagg

SEQ ID NO: 46137 - RNA, 20 nt, Artificial Sequence
  CIITA targeting sequence
ccugaggucaggaguuugag

SEQ ID NO: 46138 - RNA, 20 nt, Artificial Sequence
  CIITA targeting sequence
accagccucagguucccuaa

SEQ ID NO: 46139 - RNA, 20 nt, Artificial Sequence
  CIITA targeting sequence
gguucccuaagugcugggau

SEQ ID NO: 46140 - RNA, 20 nt, Artificial Sequence
  CIITA targeting sequence
cuaagugcugggauuacagg

SEQ ID NO: 46141 - RNA, 20 nt, Artificial Sequence
  CIITA targeting sequence
cagcacuuagggaaccugag

SEQ ID NO: 46142 - RNA, 20 nt, Artificial Sequence
  CIITA targeting sequence
ugccuguaaucccagcacuu

SEQ ID NO: 46143 - RNA, 20 nt, Artificial Sequence
  CIITA targeting sequence
agcugggcacgguggcucau

SEQ ID NO: 46144 - RNA, 20 nt, Artificial Sequence
  CIITA targeting sequence
uuuuggaaaucaaaaagacc

SEQ ID NO: 46145 - RNA, 20 nt, Artificial Sequence
  CIITA targeting sequence
aaaaagauauuuaaaaaaaa

SEQ ID NO: 46146 - RNA, 20 nt, Artificial Sequence
  CIITA targeting sequence
aaaagacccuuggguuaaag

SEQ ID NO: 46147 - RNA, 20 nt, Artificial Sequence
  CIITA targeting sequence
uuuugauuuccaaaaagaua

SEQ ID NO: 46148 - RNA, 20 nt, Artificial Sequence
  CIITA targeting sequence
uuaacccaagggucuuuuug

SEQ ID NO: 46149 - RNA, 20 nt, Artificial Sequence
  CIITA targeting sequence
ucuuuaacccaagggucuuu

SEQ ID NO: 46150 - RNA, 20 nt, Artificial Sequence
  CIITA targeting sequence
caucuuuaacccaagggucu

SEQ ID NO: 46151 - RNA, 20 nt, Artificial Sequence
  CIITA targeting sequence
cccuugacuagaauggacuu

SEQ ID NO: 46152 - RNA, 20 nt, Artificial Sequence
  CIITA targeting sequence
agggggacacaguuucucau

SEQ ID NO: 46153 - RNA, 20 nt, Artificial Sequence
  CIITA targeting sequence
agucaagggggacacaguuu

SEQ ID NO: 46154 - RNA, 20 nt, Artificial Sequence
  CIITA targeting sequence
auucuagucaagggggacac

SEQ ID NO: 46155 - RNA, 20 nt, Artificial Sequence
  CIITA targeting sequence
aaaaaaaaaaauaaguccau

SEQ ID NO: 46156 - RNA, 20 nt, Artificial Sequence
  CIITA targeting sequence
cuaaaaaaaaaaauaagucc

SEQ ID NO: 46157 - RNA, 20 nt, Artificial Sequence
  CIITA targeting sequence
ugcuguguugccagggcugg

SEQ ID NO: 46158 - RNA, 20 nt, Artificial Sequence
  CIITA targeting sequence
caaacuccugagcucaaacg

SEQ ID NO: 46159 - RNA, 20 nt, Artificial Sequence
  CIITA targeting sequence
aacuccugagcucaaacgau

SEQ ID NO: 46160 - RNA, 20 nt, Artificial Sequence
  CIITA targeting sequence
ugagcucaaacgauucuucc

SEQ ID NO: 46161 - RNA, 20 nt, Artificial Sequence
  CIITA targeting sequence
ggaguuugagaccagcccug

SEQ ID NO: 46162 - RNA, 20 nt, Artificial Sequence
  CIITA targeting sequence
aacgauucuuccuccucagc

SEQ ID NO: 46163 - RNA, 20 nt, Artificial Sequence
  CIITA targeting sequence
uuugagcucaggaguuugag

SEQ ID NO: 46164 - RNA, 20 nt, Artificial Sequence
  CIITA targeting sequence
uccuccucagccucccaaca

SEQ ID NO: 46165 - RNA, 20 nt, Artificial Sequence
  CIITA targeting sequence
uccucagccucccaacaugc

SEQ ID NO: 46166 - RNA, 20 nt, Artificial Sequence
  CIITA targeting sequence
ucagccucccaacaugcugg

SEQ ID NO: 46167 - RNA, 20 nt, Artificial Sequence
  CIITA targeting sequence
gccucccaacaugcugggau

SEQ ID NO: 46168 - RNA, 20 nt, Artificial Sequence
  CIITA targeting sequence
caacaugcugggauuacagg

SEQ ID NO: 46169 - RNA, 20 nt, Artificial Sequence
  CIITA targeting sequence
cagcauguugggaggcugag

SEQ ID NO: 46170 - RNA, 20 nt, Artificial Sequence
  CIITA targeting sequence
ugccuguaaucccagcaugu

SEQ ID NO: 46171 - RNA, 20 nt, Artificial Sequence
  CIITA targeting sequence
aggcagggugcaguagcuca

SEQ ID NO: 46172 - RNA, 20 nt, Artificial Sequence
  CIITA targeting sequence
guucuaggcagggugcagua

SEQ ID NO: 46173 - RNA, 20 nt, Artificial Sequence
  CIITA targeting sequence
uucuaggucccaagaugaca

SEQ ID NO: 46174 - RNA, 20 nt, Artificial Sequence
  CIITA targeting sequence
aggucccaagaugacacccu

SEQ ID NO: 46175 - RNA, 20 nt, Artificial Sequence
  CIITA targeting sequence
caagaugacacccuguccau

SEQ ID NO: 46176 - RNA, 20 nt, Artificial Sequence
  CIITA targeting sequence
ugggaccuagaaugacacgu

SEQ ID NO: 46177 - RNA, 20 nt, Artificial Sequence
  CIITA targeting sequence
ucuugggaccuagaaugaca

SEQ ID NO: 46178 - RNA, 20 nt, Artificial Sequence
  CIITA targeting sequence
aucugucaucuuagaaaagc

SEQ ID NO: 46179 - RNA, 20 nt, Artificial Sequence
  CIITA targeting sequence
gucaucuuagaaaagcugcu

SEQ ID NO: 46180 - RNA, 20 nt, Artificial Sequence
  CIITA targeting sequence
ucuuagaaaagcugcugagc

SEQ ID NO: 46181 - RNA, 20 nt, Artificial Sequence
  CIITA targeting sequence
uagaaaagcugcugagcucu

SEQ ID NO: 46182 - RNA, 20 nt, Artificial Sequence
  CIITA targeting sequence
aagaugacagauggacaggg

SEQ ID NO: 46183 - RNA, 20 nt, Artificial Sequence
  CIITA targeting sequence
gcagcuuuucuaagaugaca

SEQ ID NO: 46184 - RNA, 20 nt, Artificial Sequence
  CIITA targeting sequence
uagggucuccaugauucuua

SEQ ID NO: 46185 - RNA, 20 nt, Artificial Sequence
  CIITA targeting sequence
ccaugauucuuaaacaguua

SEQ ID NO: 46186 - RNA, 20 nt, Artificial Sequence
  CIITA targeting sequence
augauucuuaaacaguuauc

SEQ ID NO: 46187 - RNA, 20 nt, Artificial Sequence
  CIITA targeting sequence
uggagacccuaagagcucag

SEQ ID NO: 46188 - RNA, 20 nt, Artificial Sequence
  CIITA targeting sequence
uaaacaguuauccaacaaag

SEQ ID NO: 46189 - RNA, 20 nt, Artificial Sequence
  CIITA targeting sequence
aacaaagucccuaagaaaau

SEQ ID NO: 46190 - RNA, 20 nt, Artificial Sequence
  CIITA targeting sequence
cuaagaaaauuuuguuuuua

SEQ ID NO: 46191 - RNA, 20 nt, Artificial Sequence
  CIITA targeting sequence
uagggacuuuguuggauaac

SEQ ID NO: 46192 - RNA, 20 nt, Artificial Sequence
  CIITA targeting sequence
aaaauuuuaaaauguaguaa

SEQ ID NO: 46193 - RNA, 20 nt, Artificial Sequence
  CIITA targeting sequence
aaaauuauuccaaaauuuua

SEQ ID NO: 46194 - RNA, 20 nt, Artificial Sequence
  CIITA targeting sequence
aagauaguauagaauguucc

SEQ ID NO: 46195 - RNA, 20 nt, Artificial Sequence
  CIITA targeting sequence
aaacuauuuuauaaaucuaa

SEQ ID NO: 46196 - RNA, 20 nt, Artificial Sequence
  CIITA targeting sequence
ucgaaacuauuuuauaaauc

SEQ ID NO: 46197 - RNA, 20 nt, Artificial Sequence
  CIITA targeting sequence
auacuaucuucgaaacuauu

SEQ ID NO: 46198 - RNA, 20 nt, Artificial Sequence
  CIITA targeting sequence
cauuguaagugucuuacauu

SEQ ID NO: 46199 - RNA, 20 nt, Artificial Sequence
  CIITA targeting sequence
uacauuacuggggugaauug

SEQ ID NO: 46200 - RNA, 20 nt, Artificial Sequence
  CIITA targeting sequence
ccccaguaauguaagacacu

SEQ ID NO: 46201 - RNA, 20 nt, Artificial Sequence
  CIITA targeting sequence
uaguuuugcccaauucaccc

SEQ ID NO: 46202 - RNA, 20 nt, Artificial Sequence
  CIITA targeting sequence
guuucuuaguuuugcccaau

SEQ ID NO: 46203 - RNA, 20 nt, Artificial Sequence
  CIITA targeting sequence
acaauacuguaccaauguca

SEQ ID NO: 46204 - RNA, 20 nt, Artificial Sequence
  CIITA targeting sequence
acuucagcccucauuuggau

SEQ ID NO: 46205 - RNA, 20 nt, Artificial Sequence
  CIITA targeting sequence
gcccucauuuggauuuugcc

SEQ ID NO: 46206 - RNA, 20 nt, Artificial Sequence
  CIITA targeting sequence
uuuggauuuugccaguuuuu

SEQ ID NO: 46207 - RNA, 20 nt, Artificial Sequence
  CIITA targeting sequence
aaaugagggcugaaguugac

SEQ ID NO: 46208 - RNA, 20 nt, Artificial Sequence
  CIITA targeting sequence
uuaauaucuccuuucugucc

SEQ ID NO: 46209 - RNA, 20 nt, Artificial Sequence
  CIITA targeting sequence
ccuuucuguccuagcauccc

SEQ ID NO: 46210 - RNA, 20 nt, Artificial Sequence
  CIITA targeting sequence
uuucuguccuagcaucccau

SEQ ID NO: 46211 - RNA, 20 nt, Artificial Sequence
  CIITA targeting sequence
guccuagcaucccauccaug

SEQ ID NO: 46212 - RNA, 20 nt, Artificial Sequence
  CIITA targeting sequence
uagcaucccauccauguucc

SEQ ID NO: 46213 - RNA, 20 nt, Artificial Sequence
  CIITA targeting sequence
cauccauguucccauaguac

SEQ ID NO: 46214 - RNA, 20 nt, Artificial Sequence
  CIITA targeting sequence
auguucccauaguacauuuu

SEQ ID NO: 46215 - RNA, 20 nt, Artificial Sequence
  CIITA targeting sequence
cauaguacauuuuguugucg

SEQ ID NO: 46216 - RNA, 20 nt, Artificial Sequence
  CIITA targeting sequence
uauauccccagccucugauc

SEQ ID NO: 46217 - RNA, 20 nt, Artificial Sequence
  CIITA targeting sequence
ccagccucugaucugugacu

SEQ ID NO: 46218 - RNA, 20 nt, Artificial Sequence
  CIITA targeting sequence
gaucugugacucuuuuuuag

SEQ ID NO: 46219 - RNA, 20 nt, Artificial Sequence
  CIITA targeting sequence
gaggcuggggauauacgaca

SEQ ID NO: 46220 - RNA, 20 nt, Artificial Sequence
  CIITA targeting sequence
gugacucuuuuuuagucuuc

SEQ ID NO: 46221 - RNA, 20 nt, Artificial Sequence
  CIITA targeting sequence
cagaucagaggcuggggaua

SEQ ID NO: 46222 - RNA, 20 nt, Artificial Sequence
  CIITA targeting sequence
uuuuuagucuuccauuguuu

SEQ ID NO: 46223 - RNA, 20 nt, Artificial Sequence
  CIITA targeting sequence
uccauuguuuuugccacccu

SEQ ID NO: 46224 - RNA, 20 nt, Artificial Sequence
  CIITA targeting sequence
auuguuuuugccacccugaa

SEQ ID NO: 46225 - RNA, 20 nt, Artificial Sequence
  CIITA targeting sequence
ggguggcaaaaacaauggaa

SEQ ID NO: 46226 - RNA, 20 nt, Artificial Sequence
  CIITA targeting sequence
aaacuuucaggguggcaaaa

SEQ ID NO: 46227 - RNA, 20 nt, Artificial Sequence
  CIITA targeting sequence
caaaacuuucaggguggcaa

SEQ ID NO: 46228 - RNA, 20 nt, Artificial Sequence
  CIITA targeting sequence
ccuguggaaugucucccaau

SEQ ID NO: 46229 - RNA, 20 nt, Artificial Sequence
  CIITA targeting sequence
uguggaaugucucccaaucu

SEQ ID NO: 46230 - RNA, 20 nt, Artificial Sequence
  CIITA targeting sequence
acaggagaccuggcuagcau

SEQ ID NO: 46231 - RNA, 20 nt, Artificial Sequence
  CIITA targeting sequence
cccaaucuggguuugucuca

SEQ ID NO: 46232 - RNA, 20 nt, Artificial Sequence
  CIITA targeting sequence
caaucuggguuugucucaug

SEQ ID NO: 46233 - RNA, 20 nt, Artificial Sequence
  CIITA targeting sequence
ggguuugucucauguuuuuc

SEQ ID NO: 46234 - RNA, 20 nt, Artificial Sequence
  CIITA targeting sequence
cauguuuuucucaugauuaa

SEQ ID NO: 46235 - RNA, 20 nt, Artificial Sequence
  CIITA targeting sequence
uguuuuucucaugauuaaac

SEQ ID NO: 46236 - RNA, 20 nt, Artificial Sequence
  CIITA targeting sequence
caugauuaaacuggcaguua

SEQ ID NO: 46237 - RNA, 20 nt, Artificial Sequence
  CIITA targeting sequence
ugauuaaacuggcaguuaag

SEQ ID NO: 46238 - RNA, 20 nt, Artificial Sequence
  CIITA targeting sequence
ugagaaaaacaugagacaaa

SEQ ID NO: 46239 - RNA, 20 nt, Artificial Sequence
  CIITA targeting sequence
ccuuaacugccaguuuaauc

SEQ ID NO: 46240 - RNA, 20 nt, Artificial Sequence
  CIITA targeting sequence
uccccuuaacugccaguuua

SEQ ID NO: 46241 - RNA, 20 nt, Artificial Sequence
  CIITA targeting sequence
uauagcuuucuuccccuuaa

SEQ ID NO: 46242 - RNA, 20 nt, Artificial Sequence
  CIITA targeting sequence
ccucucuugccaucaucaca

SEQ ID NO: 46243 - RNA, 20 nt, Artificial Sequence
  CIITA targeting sequence
cuugccaucaucacaaggca

SEQ ID NO: 46244 - RNA, 20 nt, Artificial Sequence
  CIITA targeting sequence
ugccaucaucacaaggcauu

SEQ ID NO: 46245 - RNA, 20 nt, Artificial Sequence
  CIITA targeting sequence
ucacaaggcauucacaauau

SEQ ID NO: 46246 - RNA, 20 nt, Artificial Sequence
  CIITA targeting sequence
caaggcauucacaauaucca

SEQ ID NO: 46247 - RNA, 20 nt, Artificial Sequence
  CIITA targeting sequence
caauauccacaugacauccu

SEQ ID NO: 46248 - RNA, 20 nt, Artificial Sequence
  CIITA targeting sequence
acaugacauccuggugaugu

SEQ ID NO: 46249 - RNA, 20 nt, Artificial Sequence
  CIITA targeting sequence
uguggauauugugaaugccu

SEQ ID NO: 46250 - RNA, 20 nt, Artificial Sequence
  CIITA targeting sequence
uggugauguuaccuuuauca

SEQ ID NO: 46251 - RNA, 20 nt, Artificial Sequence
  CIITA targeting sequence
ccaggaugucauguggauau

SEQ ID NO: 46252 - RNA, 20 nt, Artificial Sequence
  CIITA targeting sequence
ccugguuaaggugcugucug

SEQ ID NO: 46253 - RNA, 20 nt, Artificial Sequence
  CIITA targeting sequence
gccagguuucucuacuauaa

SEQ ID NO: 46254 - RNA, 20 nt, Artificial Sequence
  CIITA targeting sequence
cuacuauaaagcuacugucu

SEQ ID NO: 46255 - RNA, 20 nt, Artificial Sequence
  CIITA targeting sequence
acuauaaagcuacugucuuc

SEQ ID NO: 46256 - RNA, 20 nt, Artificial Sequence
  CIITA targeting sequence
ucuccuuuccccacacuguu

SEQ ID NO: 46257 - RNA, 20 nt, Artificial Sequence
  CIITA targeting sequence
ccuuuccccacacuguucuu

SEQ ID NO: 46258 - RNA, 20 nt, Artificial Sequence
  CIITA targeting sequence
uuuccccacacuguucuuua

SEQ ID NO: 46259 - RNA, 20 nt, Artificial Sequence
  CIITA targeting sequence
ccacacuguucuuuagaaga

SEQ ID NO: 46260 - RNA, 20 nt, Artificial Sequence
  CIITA targeting sequence
uuagaagagagucaccaagu

SEQ ID NO: 46261 - RNA, 20 nt, Artificial Sequence
  CIITA targeting sequence
aaagaacaguguggggaaag

SEQ ID NO: 46262 - RNA, 20 nt, Artificial Sequence
  CIITA targeting sequence
ucuaaagaacagugugggga

SEQ ID NO: 46263 - RNA, 20 nt, Artificial Sequence
  CIITA targeting sequence
cuucuaaagaacaguguggg

SEQ ID NO: 46264 - RNA, 20 nt, Artificial Sequence
  CIITA targeting sequence
ccaagucuaccccacguuuu

SEQ ID NO: 46265 - RNA, 20 nt, Artificial Sequence
  CIITA targeting sequence
accccacguuuucaugauga

SEQ ID NO: 46266 - RNA, 20 nt, Artificial Sequence
  CIITA targeting sequence
ugaugaggggguggggguua

SEQ ID NO: 46267 - RNA, 20 nt, Artificial Sequence
  CIITA targeting sequence
ugaaaacgugggguagacuu

SEQ ID NO: 46268 - RNA, 20 nt, Artificial Sequence
  CIITA targeting sequence
ucaugaaaacgugggguaga

SEQ ID NO: 46269 - RNA, 20 nt, Artificial Sequence
  CIITA targeting sequence
accuucuagaagggggcagu

SEQ ID NO: 46270 - RNA, 20 nt, Artificial Sequence
  CIITA targeting sequence
agaagggggcaguaucuaca

SEQ ID NO: 46271 - RNA, 20 nt, Artificial Sequence
  CIITA targeting sequence
agaagguagaccuuaacccc

SEQ ID NO: 46272 - RNA, 20 nt, Artificial Sequence
  CIITA targeting sequence
acauguauuauuugaaauuc

SEQ ID NO: 46273 - RNA, 20 nt, Artificial Sequence
  CIITA targeting sequence
aauaauacauguagauacug

SEQ ID NO: 46274 - RNA, 20 nt, Artificial Sequence
  CIITA targeting sequence
ucugcauggaagauucaucu

SEQ ID NO: 46275 - RNA, 20 nt, Artificial Sequence
  CIITA targeting sequence
gcauggaagauucaucucuu

SEQ ID NO: 46276 - RNA, 20 nt, Artificial Sequence
  CIITA targeting sequence
augcagaagaauuucaaaua

SEQ ID NO: 46277 - RNA, 20 nt, Artificial Sequence
  CIITA targeting sequence
uccaugcagaagaauuucaa

SEQ ID NO: 46278 - RNA, 20 nt, Artificial Sequence
  CIITA targeting sequence
ucucuucucucucauuuaug

SEQ ID NO: 46279 - RNA, 20 nt, Artificial Sequence
  CIITA targeting sequence
cuucucucucauuuaugcag

SEQ ID NO: 46280 - RNA, 20 nt, Artificial Sequence
  CIITA targeting sequence
ucucucucauuuaugcaguc

SEQ ID NO: 46281 - RNA, 20 nt, Artificial Sequence
  CIITA targeting sequence
cucucauuuaugcagucauu

SEQ ID NO: 46282 - RNA, 20 nt, Artificial Sequence
  CIITA targeting sequence
cucauuuaugcagucauuug

SEQ ID NO: 46283 - RNA, 20 nt, Artificial Sequence
  CIITA targeting sequence
cauuuaugcagucauuugcu

SEQ ID NO: 46284 - RNA, 20 nt, Artificial Sequence
  CIITA targeting sequence
uuuaugcagucauuugcuua

SEQ ID NO: 46285 - RNA, 20 nt, Artificial Sequence
  CIITA targeting sequence
uuugcuuauauuaauaugga

SEQ ID NO: 46286 - RNA, 20 nt, Artificial Sequence
  CIITA targeting sequence
auauuaauauaagcaaauga

SEQ ID NO: 46287 - RNA, 20 nt, Artificial Sequence
  CIITA targeting sequence
uggauauuuauuuauacuuu

SEQ ID NO: 46288 - RNA, 20 nt, Artificial Sequence
  CIITA targeting sequence
acgaguccauauuaauauaa

SEQ ID NO: 46289 - RNA, 20 nt, Artificial Sequence
  CIITA targeting sequence
guauguuguuauuuuauugc

SEQ ID NO: 46290 - RNA, 20 nt, Artificial Sequence
  CIITA targeting sequence
aguuguuucagccuuggcua

SEQ ID NO: 46291 - RNA, 20 nt, Artificial Sequence
  CIITA targeting sequence
gccuuggcuauuaggagcuc

SEQ ID NO: 46292 - RNA, 20 nt, Artificial Sequence
  CIITA targeting sequence
uaauagccaaggcugaaaca

SEQ ID NO: 46293 - RNA, 20 nt, Artificial Sequence
  CIITA targeting sequence
uucaggcugguucuuguauc

SEQ ID NO: 46294 - RNA, 20 nt, Artificial Sequence
  CIITA targeting sequence
ggcugguucuuguauccccu

SEQ ID NO: 46295 - RNA, 20 nt, Artificial Sequence
  CIITA targeting sequence
uguauccccucgauaugcuc

SEQ ID NO: 46296 - RNA, 20 nt, Artificial Sequence
  CIITA targeting sequence
ccucgauaugcucucuuccu

SEQ ID NO: 46297 - RNA, 20 nt, Artificial Sequence
  CIITA targeting sequence
auaugcucucuuccuuuugu

SEQ ID NO: 46298 - RNA, 20 nt, Artificial Sequence
  CIITA targeting sequence
aggggauacaagaaccagcc

SEQ ID NO: 46299 - RNA, 20 nt, Artificial Sequence
  CIITA targeting sequence
cuuccuuuuguuuuuugagc

SEQ ID NO: 46300 - RNA, 20 nt, Artificial Sequence
  CIITA targeting sequence
uccuuuuguuuuuugagcac

SEQ ID NO: 46301 - RNA, 20 nt, Artificial Sequence
  CIITA targeting sequence
uuuuguuuuuugagcacuuc

SEQ ID NO: 46302 - RNA, 20 nt, Artificial Sequence
  CIITA targeting sequence
aaaaacaaaaggaagagagc

SEQ ID NO: 46303 - RNA, 20 nt, Artificial Sequence
  CIITA targeting sequence
uacuuccugguacuguaaaa

SEQ ID NO: 46304 - RNA, 20 nt, Artificial Sequence
  CIITA targeting sequence
ugguacuguaaaaugcucca

SEQ ID NO: 46305 - RNA, 20 nt, Artificial Sequence
  CIITA targeting sequence
aguccuacaaucacccuuuu

SEQ ID NO: 46306 - RNA, 20 nt, Artificial Sequence
  CIITA targeting sequence
uacaaucacccuuuuuuccc

SEQ ID NO: 46307 - RNA, 20 nt, Artificial Sequence
  CIITA targeting sequence
cccuuuuuucccaaugaauu

SEQ ID NO: 46308 - RNA, 20 nt, Artificial Sequence
  CIITA targeting sequence
caaugaauugcccacucccc

SEQ ID NO: 46309 - RNA, 20 nt, Artificial Sequence
  CIITA targeting sequence
uugggaaaaaagggugauug

SEQ ID NO: 46310 - RNA, 20 nt, Artificial Sequence
  CIITA targeting sequence
ccuauggaguuuuaaaaaau

SEQ ID NO: 46311 - RNA, 20 nt, Artificial Sequence
  CIITA targeting sequence
auaggggagugggcaauuca

SEQ ID NO: 46312 - RNA, 20 nt, Artificial Sequence
  CIITA targeting sequence
agguucauggauuuuaugcu

SEQ ID NO: 46313 - RNA, 20 nt, Artificial Sequence
  CIITA targeting sequence
uggauuuuaugcuagaccua

SEQ ID NO: 46314 - RNA, 20 nt, Artificial Sequence
  CIITA targeting sequence
augaaccuagauuuuuuaaa

SEQ ID NO: 46315 - RNA, 20 nt, Artificial Sequence
  CIITA targeting sequence
agcauaaaauccaugaaccu

SEQ ID NO: 46316 - RNA, 20 nt, Artificial Sequence
  CIITA targeting sequence
auccccggggcaagaucuag

SEQ ID NO: 46317 - RNA, 20 nt, Artificial Sequence
  CIITA targeting sequence
ccggggcaagaucuagguac

SEQ ID NO: 46318 - RNA, 20 nt, Artificial Sequence
  CIITA targeting sequence
ugccccggggauugacaggg

SEQ ID NO: 46319 - RNA, 20 nt, Artificial Sequence
  CIITA targeting sequence
agguacaggcauuuuaacaa

SEQ ID NO: 46320 - RNA, 20 nt, Artificial Sequence
  CIITA targeting sequence
caaguuggucacagugcggc

SEQ ID NO: 46321 - RNA, 20 nt, Artificial Sequence
  CIITA targeting sequence
cagugcggcagugaguuugc

SEQ ID NO: 46322 - RNA, 20 nt, Artificial Sequence
  CIITA targeting sequence
cugccgcacugugaccaacu

SEQ ID NO: 46323 - RNA, 20 nt, Artificial Sequence
  CIITA targeting sequence
uaagggccaccagcaaacuc

SEQ ID NO: 46324 - RNA, 20 nt, Artificial Sequence
  CIITA targeting sequence
cugauuuaugcagcuugaac

SEQ ID NO: 46325 - RNA, 20 nt, Artificial Sequence
  CIITA targeting sequence
gugacuccuaagggccacca

SEQ ID NO: 46326 - RNA, 20 nt, Artificial Sequence
  CIITA targeting sequence
agcugcauaaaucagugacu

SEQ ID NO: 46327 - RNA, 20 nt, Artificial Sequence
  CIITA targeting sequence
guucaagcugcauaaaucag

SEQ ID NO: 46328 - RNA, 20 nt, Artificial Sequence
  CIITA targeting sequence
accuucaguucaagcugcau

SEQ ID NO: 46329 - RNA, 20 nt, Artificial Sequence
  CIITA targeting sequence
uuuggccuauuuuugucuac

SEQ ID NO: 46330 - RNA, 20 nt, Artificial Sequence
  CIITA targeting sequence
gucauuuggccuauuuuugu

SEQ ID NO: 46331 - RNA, 20 nt, Artificial Sequence
  CIITA targeting sequence
ggaggucaacaugaauggca

SEQ ID NO: 46332 - RNA, 20 nt, Artificial Sequence
  CIITA targeting sequence
agaguauuucugucauuugg

SEQ ID NO: 46333 - RNA, 20 nt, Artificial Sequence
  CIITA targeting sequence
acaugaauggcauuuacagg

SEQ ID NO: 46334 - RNA, 20 nt, Artificial Sequence
  CIITA targeting sequence
uguugaccuccagaguauuu

SEQ ID NO: 46335 - RNA, 20 nt, Artificial Sequence
  CIITA targeting sequence
gccuguaaaugccauucaug

SEQ ID NO: 46336 - RNA, 20 nt, Artificial Sequence
  CIITA targeting sequence
gaguuggagaagauuguaag

SEQ ID NO: 46337 - RNA, 20 nt, Artificial Sequence
  CIITA targeting sequence
gaggcccaucugccuguaaa

SEQ ID NO: 46338 - RNA, 20 nt, Artificial Sequence
  CIITA targeting sequence
aacucggaggcccaucugcc

SEQ ID NO: 46339 - RNA, 20 nt, Artificial Sequence
  CIITA targeting sequence
ccaacucggaggcccaucug

SEQ ID NO: 46340 - RNA, 20 nt, Artificial Sequence
  CIITA targeting sequence
ucuccaacucggaggcccau

SEQ ID NO: 46341 - RNA, 20 nt, Artificial Sequence
  CIITA targeting sequence
uuuuuaggccauuuaaauuu

SEQ ID NO: 46342 - RNA, 20 nt, Artificial Sequence
  CIITA targeting sequence
uuuauccguucauggauuca

SEQ ID NO: 46343 - RNA, 20 nt, Artificial Sequence
  CIITA targeting sequence
guucauggauucagacagaa

SEQ ID NO: 46344 - RNA, 20 nt, Artificial Sequence
  CIITA targeting sequence
uggauucagacagaaucagg

SEQ ID NO: 46345 - RNA, 20 nt, Artificial Sequence
  CIITA targeting sequence
augaacggauaaaugaaaaa

SEQ ID NO: 46346 - RNA, 20 nt, Artificial Sequence
  CIITA targeting sequence
gacagaaucaggcagcacug

SEQ ID NO: 46347 - RNA, 20 nt, Artificial Sequence
  CIITA targeting sequence
gaauccaugaacggauaaau

SEQ ID NO: 46348 - RNA, 20 nt, Artificial Sequence
  CIITA targeting sequence
gucugaauccaugaacggau

SEQ ID NO: 46349 - RNA, 20 nt, Artificial Sequence
  CIITA targeting sequence
ggcagcacugaguaaguucc

SEQ ID NO: 46350 - RNA, 20 nt, Artificial Sequence
  CIITA targeting sequence
gugcugccugauucugucug

SEQ ID NO: 46351 - RNA, 20 nt, Artificial Sequence
  CIITA targeting sequence
aggcccaugaccucaccacu

SEQ ID NO: 46352 - RNA, 20 nt, Artificial Sequence
  CIITA targeting sequence
ugggccuggaacuuacucag

SEQ ID NO: 46353 - RNA, 20 nt, Artificial Sequence
  CIITA targeting sequence
ccacuguggagaugccagac

SEQ ID NO: 46354 - RNA, 20 nt, Artificial Sequence
  CIITA targeting sequence
acaguggugaggucaugggc

SEQ ID NO: 46355 - RNA, 20 nt, Artificial Sequence
  CIITA targeting sequence
ccacaguggugaggucaugg

SEQ ID NO: 46356 - RNA, 20 nt, Artificial Sequence
  CIITA targeting sequence
ggcaucuccacaguggugag

SEQ ID NO: 46357 - RNA, 20 nt, Artificial Sequence
  CIITA targeting sequence
ucuggcaucuccacaguggu

SEQ ID NO: 46358 - RNA, 20 nt, Artificial Sequence
  CIITA targeting sequence
ucgucuggcaucuccacagu

SEQ ID NO: 46359 - RNA, 20 nt, Artificial Sequence
  CIITA targeting sequence
guccucgucuggcaucucca

SEQ ID NO: 46360 - RNA, 20 nt, Artificial Sequence
  CIITA targeting sequence
cuguccucgucuggcaucuc

SEQ ID NO: 46361 - RNA, 20 nt, Artificial Sequence
  CIITA targeting sequence
guugugggugccucucuguc

SEQ ID NO: 46362 - RNA, 20 nt, Artificial Sequence
  CIITA targeting sequence
gcccgcaggcacaccucauu

SEQ ID NO: 46363 - RNA, 20 nt, Artificial Sequence
  CIITA targeting sequence
uuucuuccaagugucccaga

SEQ ID NO: 46364 - RNA, 20 nt, Artificial Sequence
  CIITA targeting sequence
uccaagugucccagaugcaa

SEQ ID NO: 46365 - RNA, 20 nt, Artificial Sequence
  CIITA targeting sequence
aagugucccagaugcaagau

SEQ ID NO: 46366 - RNA, 20 nt, Artificial Sequence
  CIITA targeting sequence
cagaugcaagauuaucuggu

SEQ ID NO: 46367 - RNA, 20 nt, Artificial Sequence
  CIITA targeting sequence
gggacacuuggaagaaauga

SEQ ID NO: 46368 - RNA, 20 nt, Artificial Sequence
  CIITA targeting sequence
ugcaucugggacacuuggaa

SEQ ID NO: 46369 - RNA, 20 nt, Artificial Sequence
  CIITA targeting sequence
gguguuagcuugaguacaga

SEQ ID NO: 46370 - RNA, 20 nt, Artificial Sequence
  CIITA targeting sequence
agcuaacaccagauaaucuu

SEQ ID NO: 46371 - RNA, 20 nt, Artificial Sequence
  CIITA targeting sequence
guacucaagcuaacaccaga

SEQ ID NO: 46372 - RNA, 20 nt, Artificial Sequence
  CIITA targeting sequence
cuguacucaagcuaacacca

SEQ ID NO: 46373 - RNA, 20 nt, Artificial Sequence
  CIITA targeting sequence
aguuauguguucucuguacu

SEQ ID NO: 46374 - RNA, 20 nt, Artificial Sequence
  CIITA targeting sequence
uucucuuccuuuagagaaag

SEQ ID NO: 46375 - RNA, 20 nt, Artificial Sequence
  CIITA targeting sequence
cuuccuuuagagaaaggcac

SEQ ID NO: 46376 - RNA, 20 nt, Artificial Sequence
  CIITA targeting sequence
uccuuuagagaaaggcacug

SEQ ID NO: 46377 - RNA, 20 nt, Artificial Sequence
  CIITA targeting sequence
uuuagagaaaggcacuggau

SEQ ID NO: 46378 - RNA, 20 nt, Artificial Sequence
  CIITA targeting sequence
aaaggaagagaaugacguuu

SEQ ID NO: 46379 - RNA, 20 nt, Artificial Sequence
  CIITA targeting sequence
cuaaaggaagagaaugacgu

SEQ ID NO: 46380 - RNA, 20 nt, Artificial Sequence
  CIITA targeting sequence
agugccuuucucuaaaggaa

SEQ ID NO: 46381 - RNA, 20 nt, Artificial Sequence
  CIITA targeting sequence
guuuccuuuucaagacugaa

SEQ ID NO: 46382 - RNA, 20 nt, Artificial Sequence
  CIITA targeting sequence
uuuucaagacugaaagagcc

SEQ ID NO: 46383 - RNA, 20 nt, Artificial Sequence
  CIITA targeting sequence
agacugaaagagccaacgug

SEQ ID NO: 46384 - RNA, 20 nt, Artificial Sequence
  CIITA targeting sequence
ugaaaaggaaacagaccauc

SEQ ID NO: 46385 - RNA, 20 nt, Artificial Sequence
  CIITA targeting sequence
gucuugaaaaggaaacagac

SEQ ID NO: 46386 - RNA, 20 nt, Artificial Sequence
  CIITA targeting sequence
uucagucuugaaaaggaaac

SEQ ID NO: 46387 - RNA, 20 nt, Artificial Sequence
  CIITA targeting sequence
ggggguacacguuggcucuu

SEQ ID NO: 46388 - RNA, 20 nt, Artificial Sequence
  CIITA targeting sequence
guacacagccuagcggcacu

SEQ ID NO: 46389 - RNA, 20 nt, Artificial Sequence
  CIITA targeting sequence
uauccacaaggagaaaggca

SEQ ID NO: 46390 - RNA, 20 nt, Artificial Sequence
  CIITA targeting sequence
acaaggagaaaggcagaaac

SEQ ID NO: 46391 - RNA, 20 nt, Artificial Sequence
  CIITA targeting sequence
uuguggauaggauacuuguc

SEQ ID NO: 46392 - RNA, 20 nt, Artificial Sequence
  CIITA targeting sequence
ccuuguggauaggauacuug

SEQ ID NO: 46393 - RNA, 20 nt, Artificial Sequence
  CIITA targeting sequence
gccuuucuccuuguggauag

SEQ ID NO: 46394 - RNA, 20 nt, Artificial Sequence
  CIITA targeting sequence
guuucugccuuucuccuugu

SEQ ID NO: 46395 - RNA, 20 nt, Artificial Sequence
  CIITA targeting sequence
ccaggucuguuucugccuuu

SEQ ID NO: 46396 - RNA, 20 nt, Artificial Sequence
  CIITA targeting sequence
ccaccacaucaguaccugug

SEQ ID NO: 46397 - RNA, 20 nt, Artificial Sequence
  CIITA targeting sequence
accacaucaguaccugugua

SEQ ID NO: 46398 - RNA, 20 nt, Artificial Sequence
  CIITA targeting sequence
guaccuguguauuucuuucu

SEQ ID NO: 46399 - RNA, 20 nt, Artificial Sequence
  CIITA targeting sequence
uucuaguuauuuuccccuag

SEQ ID NO: 46400 - RNA, 20 nt, Artificial Sequence
  CIITA targeting sequence
aguuauuuuccccuagaacu

SEQ ID NO: 46401 - RNA, 20 nt, Artificial Sequence
  CIITA targeting sequence
ccuagaacuugacaauuugg

SEQ ID NO: 46402 - RNA, 20 nt, Artificial Sequence
  CIITA targeting sequence
aggggaaaauaacuagaaag

SEQ ID NO: 46403 - RNA, 20 nt, Artificial Sequence
  CIITA targeting sequence
aguucuaggggaaaauaacu

SEQ ID NO: 46404 - RNA, 20 nt, Artificial Sequence
  CIITA targeting sequence
caaauugucaaguucuaggg

SEQ ID NO: 46405 - RNA, 20 nt, Artificial Sequence
  CIITA targeting sequence
uaucuccccagccuccucug

SEQ ID NO: 46406 - RNA, 20 nt, Artificial Sequence
  CIITA targeting sequence
ccccagccuccucuguuccg

SEQ ID NO: 46407 - RNA, 20 nt, Artificial Sequence
  CIITA targeting sequence
ccagccuccucuguuccgug

SEQ ID NO: 46408 - RNA, 20 nt, Artificial Sequence
  CIITA targeting sequence
ucuguuccgugacucuuuuu

SEQ ID NO: 46409 - RNA, 20 nt, Artificial Sequence
  CIITA targeting sequence
guuccgugacucuuuuuuag

SEQ ID NO: 46410 - RNA, 20 nt, Artificial Sequence
  CIITA targeting sequence
gugacucuuuuuuagucuuc

SEQ ID NO: 46411 - RNA, 20 nt, Artificial Sequence
  CIITA targeting sequence
cggaacagaggaggcugggg

SEQ ID NO: 46412 - RNA, 20 nt, Artificial Sequence
  CIITA targeting sequence
uuuuuagucuucuguuguuu

SEQ ID NO: 46413 - RNA, 20 nt, Artificial Sequence
  CIITA targeting sequence
ucuguuguuuuuacgacccu

SEQ ID NO: 46414 - RNA, 20 nt, Artificial Sequence
  CIITA targeting sequence
guuguuuuuacgacccugaa

SEQ ID NO: 46415 - RNA, 20 nt, Artificial Sequence
  CIITA targeting sequence
uaaaaacaacagaagacuaa

SEQ ID NO: 46416 - RNA, 20 nt, Artificial Sequence
  CIITA targeting sequence
gggucguaaaaacaacagaa

SEQ ID NO: 46417 - RNA, 20 nt, Artificial Sequence
  CIITA targeting sequence
aaacuuucagggucguaaaa

SEQ ID NO: 46418 - RNA, 20 nt, Artificial Sequence
  CIITA targeting sequence
caaaacuuucagggucguaa

SEQ ID NO: 46419 - RNA, 20 nt, Artificial Sequence
  CIITA targeting sequence
ucuguggaaugucccccaaa

SEQ ID NO: 46420 - RNA, 20 nt, Artificial Sequence
  CIITA targeting sequence
guggaaugucccccaaaaug

SEQ ID NO: 46421 - RNA, 20 nt, Artificial Sequence
  CIITA targeting sequence
acagaagaccuggccagcau

SEQ ID NO: 46422 - RNA, 20 nt, Artificial Sequence
  CIITA targeting sequence
cccaaaauggguuugucuca

SEQ ID NO: 46423 - RNA, 20 nt, Artificial Sequence
  CIITA targeting sequence
cacuuuucucaugauuaaac

SEQ ID NO: 46424 - RNA, 20 nt, Artificial Sequence
  CIITA targeting sequence
cuuuucucaugauuaaacug

SEQ ID NO: 46425 - RNA, 20 nt, Artificial Sequence
  CIITA targeting sequence
caugauuaaacuggcaguua

SEQ ID NO: 46426 - RNA, 20 nt, Artificial Sequence
  CIITA targeting sequence
ugauuaaacuggcaguuaag

SEQ ID NO: 46427 - RNA, 20 nt, Artificial Sequence
  CIITA targeting sequence
ugagaaaagugagacaaacc

SEQ ID NO: 46428 - RNA, 20 nt, Artificial Sequence
  CIITA targeting sequence
ccuuaacugccaguuuaauc

SEQ ID NO: 46429 - RNA, 20 nt, Artificial Sequence
  CIITA targeting sequence
uccccuuaacugccaguuua

SEQ ID NO: 46430 - RNA, 20 nt, Artificial Sequence
  CIITA targeting sequence
caaaaagcuuuagcccuacg

SEQ ID NO: 46431 - RNA, 20 nt, Artificial Sequence
  CIITA targeting sequence
uuuuuuucuuuuuuuuuuuu

SEQ ID NO: 46432 - RNA, 20 nt, Artificial Sequence
  CIITA targeting sequence
uuuuuuuuuuuuuggcucug

SEQ ID NO: 46433 - RNA, 20 nt, Artificial Sequence
  CIITA targeting sequence
gucacccaggcuggagugca

SEQ ID NO: 46434 - RNA, 20 nt, Artificial Sequence
  CIITA targeting sequence
cccaggcuggagugcagugg

SEQ ID NO: 46435 - RNA, 20 nt, Artificial Sequence
  CIITA targeting sequence
agccugggugacagagccaa

SEQ ID NO: 46436 - RNA, 20 nt, Artificial Sequence
  CIITA targeting sequence
ggccacugcacuccagccug

SEQ ID NO: 46437 - RNA, 20 nt, Artificial Sequence
  CIITA targeting sequence
uaucucacugcagccuugaa

SEQ ID NO: 46438 - RNA, 20 nt, Artificial Sequence
  CIITA targeting sequence
cacugcagccuugaacuccu

SEQ ID NO: 46439 - RNA, 20 nt, Artificial Sequence
  CIITA targeting sequence
cugcagccuugaacuccugg

SEQ ID NO: 46440 - RNA, 20 nt, Artificial Sequence
  CIITA targeting sequence
aggcugcagugagauaugau

SEQ ID NO: 46441 - RNA, 20 nt, Artificial Sequence
  CIITA targeting sequence
ugggcucaagcgguccuccc

SEQ ID NO: 46442 - RNA, 20 nt, Artificial Sequence
  CIITA targeting sequence
agcgguccucccaccuuagc

SEQ ID NO: 46443 - RNA, 20 nt, Artificial Sequence
  CIITA targeting sequence
ucccaccuuagccuccugag

SEQ ID NO: 46444 - RNA, 20 nt, Artificial Sequence
  CIITA targeting sequence
caccuuagccuccugaguag

SEQ ID NO: 46445 - RNA, 20 nt, Artificial Sequence
  CIITA targeting sequence
ugaguagcuggcacuucagg

SEQ ID NO: 46446 - RNA, 20 nt, Artificial Sequence
  CIITA targeting sequence
ggaggcuaaggugggaggac

SEQ ID NO: 46447 - RNA, 20 nt, Artificial Sequence
  CIITA targeting sequence
ggcaugcaccaccgccuaau

SEQ ID NO: 46448 - RNA, 20 nt, Artificial Sequence
  CIITA targeting sequence
ucucuguagagguagggguc

SEQ ID NO: 46449 - RNA, 20 nt, Artificial Sequence
  CIITA targeting sequence
cuguagagguaggggucuug

SEQ ID NO: 46450 - RNA, 20 nt, Artificial Sequence
  CIITA targeting sequence
guagagguaggggucuuguu

SEQ ID NO: 46451 - RNA, 20 nt, Artificial Sequence
  CIITA targeting sequence
acagagaagaaaaaaaaaau

SEQ ID NO: 46452 - RNA, 20 nt, Artificial Sequence
  CIITA targeting sequence
uguuauuuugcccaggcugg

SEQ ID NO: 46453 - RNA, 20 nt, Artificial Sequence
  CIITA targeting sequence
ugaacuggccucaagcgauc

SEQ ID NO: 46454 - RNA, 20 nt, Artificial Sequence
  CIITA targeting sequence
agacccagccugggcaaaau

SEQ ID NO: 46455 - RNA, 20 nt, Artificial Sequence
  CIITA targeting sequence
agcgaucauccugccucagc

SEQ ID NO: 46456 - RNA, 20 nt, Artificial Sequence
  CIITA targeting sequence
cuugaggccaguucaagacc

SEQ ID NO: 46457 - RNA, 20 nt, Artificial Sequence
  CIITA targeting sequence
uccugccucagccucccaaa

SEQ ID NO: 46458 - RNA, 20 nt, Artificial Sequence
  CIITA targeting sequence
ugccucagccucccaaagua

SEQ ID NO: 46459 - RNA, 20 nt, Artificial Sequence
  CIITA targeting sequence
gccucccaaaguacugggau

SEQ ID NO: 46460 - RNA, 20 nt, Artificial Sequence
  CIITA targeting sequence
caaaguacugggauugcagg

SEQ ID NO: 46461 - RNA, 20 nt, Artificial Sequence
  CIITA targeting sequence
caguacuuugggaggcugag

SEQ ID NO: 46462 - RNA, 20 nt, Artificial Sequence
  CIITA targeting sequence
ugccugcaaucccaguacuu

SEQ ID NO: 46463 - RNA, 20 nt, Artificial Sequence
  CIITA targeting sequence
gggcacaguggcucaugccu

SEQ ID NO: 46464 - RNA, 20 nt, Artificial Sequence
  CIITA targeting sequence
aaaacucauuuaauacucau

SEQ ID NO: 46465 - RNA, 20 nt, Artificial Sequence
  CIITA targeting sequence
uuuaauacucauaauuauau

SEQ ID NO: 46466 - RNA, 20 nt, Artificial Sequence
  CIITA targeting sequence
uaauuauaucuuauuccuuu

SEQ ID NO: 46467 - RNA, 20 nt, Artificial Sequence
  CIITA targeting sequence
uauuccuuugcugggaauuc

SEQ ID NO: 46468 - RNA, 20 nt, Artificial Sequence
  CIITA targeting sequence
uuugcugggaauuccaguug

SEQ ID NO: 46469 - RNA, 20 nt, Artificial Sequence
  CIITA targeting sequence
cagcaaaggaauaagauaua

SEQ ID NO: 46470 - RNA, 20 nt, Artificial Sequence
  CIITA targeting sequence
aguuguggcgggugacaaug

SEQ ID NO: 46471 - RNA, 20 nt, Artificial Sequence
  CIITA targeting sequence
cccgccacaacuggaauucc

SEQ ID NO: 46472 - RNA, 20 nt, Artificial Sequence
  CIITA targeting sequence
ugccacccauugucacccgc

SEQ ID NO: 46473 - RNA, 20 nt, Artificial Sequence
  CIITA targeting sequence
gcacaggucaugccacccau

SEQ ID NO: 46474 - RNA, 20 nt, Artificial Sequence
  CIITA targeting sequence
cccaagguaucugcacaggu

SEQ ID NO: 46475 - RNA, 20 nt, Artificial Sequence
  CIITA targeting sequence
cccccaagguaucugcacag

SEQ ID NO: 46476 - RNA, 20 nt, Artificial Sequence
  CIITA targeting sequence
ccccucucccccaagguauc

SEQ ID NO: 46477 - RNA, 20 nt, Artificial Sequence
  CIITA targeting sequence
aauacuuguguugugaauga

SEQ ID NO: 46478 - RNA, 20 nt, Artificial Sequence
  CIITA targeting sequence
caacacaaguauuagauuca

SEQ ID NO: 46479 - RNA, 20 nt, Artificial Sequence
  CIITA targeting sequence
uucacaacacaaguauuaga

SEQ ID NO: 46480 - RNA, 20 nt, Artificial Sequence
  CIITA targeting sequence
gguuucauucacaacacaag

SEQ ID NO: 46481 - RNA, 20 nt, Artificial Sequence
  CIITA targeting sequence
guuuccacauguggaagcaa

SEQ ID NO: 46482 - RNA, 20 nt, Artificial Sequence
  CIITA targeting sequence
acauguggaagcaagccacu

SEQ ID NO: 46483 - RNA, 20 nt, Artificial Sequence
  CIITA targeting sequence
acauguggaaacagaaauua

SEQ ID NO: 46484 - RNA, 20 nt, Artificial Sequence
  CIITA targeting sequence
guggcuugcuuccacaugug

SEQ ID NO: 46485 - RNA, 20 nt, Artificial Sequence
  CIITA targeting sequence
auucucuccccagcuucuuc

SEQ ID NO: 46486 - RNA, 20 nt, Artificial Sequence
  CIITA targeting sequence
cuccccagcuucuuccugga

SEQ ID NO: 46487 - RNA, 20 nt, Artificial Sequence
  CIITA targeting sequence
ccccagcuucuuccuggaga

SEQ ID NO: 46488 - RNA, 20 nt, Artificial Sequence
  CIITA targeting sequence
ccagcuucuuccuggagaag

SEQ ID NO: 46489 - RNA, 20 nt, Artificial Sequence
  CIITA targeting sequence
uccuggagaagaauauguuu

SEQ ID NO: 46490 - RNA, 20 nt, Artificial Sequence
  CIITA targeting sequence
uggagaagaauauguuuguu

SEQ ID NO: 46491 - RNA, 20 nt, Artificial Sequence
  CIITA targeting sequence
aggaagaagcuggggagaga

SEQ ID NO: 46492 - RNA, 20 nt, Artificial Sequence
  CIITA targeting sequence
ccaggaagaagcuggggaga

SEQ ID NO: 46493 - RNA, 20 nt, Artificial Sequence
  CIITA targeting sequence
ucuccaggaagaagcugggg

SEQ ID NO: 46494 - RNA, 20 nt, Artificial Sequence
  CIITA targeting sequence
ucuugaacaucuugcggcaa

SEQ ID NO: 46495 - RNA, 20 nt, Artificial Sequence
  CIITA targeting sequence
ugaacaucuugcggcaaaag

SEQ ID NO: 46496 - RNA, 20 nt, Artificial Sequence
  CIITA targeting sequence
agaagaaaacaaacauauuc

SEQ ID NO: 46497 - RNA, 20 nt, Artificial Sequence
  CIITA targeting sequence
ugcggcaaaagucgggccgu

SEQ ID NO: 46498 - RNA, 20 nt, Artificial Sequence
  CIITA targeting sequence
ggccguuacgugugcguuca

SEQ ID NO: 46499 - RNA, 20 nt, Artificial Sequence
  CIITA targeting sequence
gcugcugcagaccuugaaca

SEQ ID NO: 46500 - RNA, 20 nt, Artificial Sequence
  CIITA targeting sequence
gcagcagcugaacgcacacg

SEQ ID NO: 46501 - RNA, 20 nt, Artificial Sequence
  CIITA targeting sequence
aggucugcagcagcugaacg

SEQ ID NO: 46502 - RNA, 20 nt, Artificial Sequence
  CIITA targeting sequence
ucuuugagaacaucagucac

SEQ ID NO: 46503 - RNA, 20 nt, Artificial Sequence
  CIITA targeting sequence
uugagaacaucagucacgag

SEQ ID NO: 46504 - RNA, 20 nt, Artificial Sequence
  CIITA targeting sequence
aagaggauguucaaggucug

SEQ ID NO: 46505 - RNA, 20 nt, Artificial Sequence
  CIITA targeting sequence
caaagaggauguucaagguc

SEQ ID NO: 46506 - RNA, 20 nt, Artificial Sequence
  CIITA targeting sequence
gucacgagaccucacuuugu

SEQ ID NO: 46507 - RNA, 20 nt, Artificial Sequence
  CIITA targeting sequence
cgagaccucacuuuguaagg

SEQ ID NO: 46508 - RNA, 20 nt, Artificial Sequence
  CIITA targeting sequence
ugacugauguucucaaagag

SEQ ID NO: 46509 - RNA, 20 nt, Artificial Sequence
  CIITA targeting sequence
cgugacugauguucucaaag

SEQ ID NO: 46510 - RNA, 20 nt, Artificial Sequence
  CIITA targeting sequence
cuuuguaaggacauuccuug

SEQ ID NO: 46511 - RNA, 20 nt, Artificial Sequence
  CIITA targeting sequence
uuacaaagugaggucucgug

SEQ ID NO: 46512 - RNA, 20 nt, Artificial Sequence
  CIITA targeting sequence
uugguauuugccucugugcu

SEQ ID NO: 46513 - RNA, 20 nt, Artificial Sequence
  CIITA targeting sequence
gugcugcugugcauguagca

SEQ ID NO: 46514 - RNA, 20 nt, Artificial Sequence
  CIITA targeting sequence
cccugcuacaugcacagcag

SEQ ID NO: 46515 - RNA, 20 nt, Artificial Sequence
  CIITA targeting sequence
gugucugcgcuuacuauucg

SEQ ID NO: 46516 - RNA, 20 nt, Artificial Sequence
  CIITA targeting sequence
gcgcuuacuauucgucggcu

SEQ ID NO: 46517 - RNA, 20 nt, Artificial Sequence
  CIITA targeting sequence
ucggcucaggcuauccuaac

SEQ ID NO: 46518 - RNA, 20 nt, Artificial Sequence
  CIITA targeting sequence
gcucaggcuauccuaacaaa

SEQ ID NO: 46519 - RNA, 20 nt, Artificial Sequence
  CIITA targeting sequence
ggcuauccuaacaaaauacc

SEQ ID NO: 46520 - RNA, 20 nt, Artificial Sequence
  CIITA targeting sequence
uaacaaaauaccauagacug

SEQ ID NO: 46521 - RNA, 20 nt, Artificial Sequence
  CIITA targeting sequence
augguauuuuguuaggauag

SEQ ID NO: 46522 - RNA, 20 nt, Artificial Sequence
  CIITA targeting sequence
gucuaugguauuuuguuagg

SEQ ID NO: 46523 - RNA, 20 nt, Artificial Sequence
  CIITA targeting sequence
auuguuuaacccacucaguc

SEQ ID NO: 46524 - RNA, 20 nt, Artificial Sequence
  CIITA targeting sequence
cuauuguuuaacccacucag

SEQ ID NO: 46525 - RNA, 20 nt, Artificial Sequence
  CIITA targeting sequence
cacuguucuggagcauugaa

SEQ ID NO: 46526 - RNA, 20 nt, Artificial Sequence
  CIITA targeting sequence
cuguucuggagcauugaagu

SEQ ID NO: 46527 - RNA, 20 nt, Artificial Sequence
  CIITA targeting sequence
ggagcauugaaguccaagau

SEQ ID NO: 46528 - RNA, 20 nt, Artificial Sequence
  CIITA targeting sequence
agaacagugagaaaacaaau

SEQ ID NO: 46529 - RNA, 20 nt, Artificial Sequence
  CIITA targeting sequence
augcuccagaacagugagaa

SEQ ID NO: 46530 - RNA, 20 nt, Artificial Sequence
  CIITA targeting sequence
aagauuggccaggcauggua

SEQ ID NO: 46531 - RNA, 20 nt, Artificial Sequence
  CIITA targeting sequence
uggacuucaaugcuccagaa

SEQ ID NO: 46532 - RNA, 20 nt, Artificial Sequence
  CIITA targeting sequence
caucccuguaaccccagcac

SEQ ID NO: 46533 - RNA, 20 nt, Artificial Sequence
  CIITA targeting sequence
ucccuguaaccccagcacuu

SEQ ID NO: 46534 - RNA, 20 nt, Artificial Sequence
  CIITA targeting sequence
cuguaaccccagcacuuagg

SEQ ID NO: 46535 - RNA, 20 nt, Artificial Sequence
  CIITA targeting sequence
uaagugcugggguuacaggg

SEQ ID NO: 46536 - RNA, 20 nt, Artificial Sequence
  CIITA targeting sequence
gcccaccuuggccuccuaag

SEQ ID NO: 46537 - RNA, 20 nt, Artificial Sequence
  CIITA targeting sequence
cuugagcucaggaguuugag

SEQ ID NO: 46538 - RNA, 20 nt, Artificial Sequence
  CIITA targeting sequence
agugaucugcccaccuuggc

SEQ ID NO: 46539 - RNA, 20 nt, Artificial Sequence
  CIITA targeting sequence
ggaguuugagaacagccugg

SEQ ID NO: 46540 - RNA, 20 nt, Artificial Sequence
  CIITA targeting sequence
ugagcucaagugaucugccc

SEQ ID NO: 46541 - RNA, 20 nt, Artificial Sequence
  CIITA targeting sequence
aacuccugagcucaagugau

SEQ ID NO: 46542 - RNA, 20 nt, Artificial Sequence
  CIITA targeting sequence
caaacuccugagcucaagug

SEQ ID NO: 46543 - RNA, 20 nt, Artificial Sequence
  CIITA targeting sequence
aggcuguucucaaacuccug

SEQ ID NO: 46544 - RNA, 20 nt, Artificial Sequence
  CIITA targeting sequence
ccuuguuguccaggcuguuc

SEQ ID NO: 46545 - RNA, 20 nt, Artificial Sequence
  CIITA targeting sequence
cuacaaaaaaccacaaaaau

SEQ ID NO: 46546 - RNA, 20 nt, Artificial Sequence
  CIITA targeting sequence
acaaaaaaccacaaaaauua

SEQ ID NO: 46547 - RNA, 20 nt, Artificial Sequence
  CIITA targeting sequence
cagcuacucaggaggcugag

SEQ ID NO: 46548 - RNA, 20 nt, Artificial Sequence
  CIITA targeting sequence
ggaggcugaggcaggaagau

SEQ ID NO: 46549 - RNA, 20 nt, Artificial Sequence
  CIITA targeting sequence
ugaguagcugggacuacaug

SEQ ID NO: 46550 - RNA, 20 nt, Artificial Sequence
  CIITA targeting sequence
gccuccugaguagcugggac

SEQ ID NO: 46551 - RNA, 20 nt, Artificial Sequence
  CIITA targeting sequence
ugccucagccuccugaguag

SEQ ID NO: 46552 - RNA, 20 nt, Artificial Sequence
  CIITA targeting sequence
uccugccucagccuccugag

SEQ ID NO: 46553 - RNA, 20 nt, Artificial Sequence
  CIITA targeting sequence
aggaagucgagguugcagug

SEQ ID NO: 46554 - RNA, 20 nt, Artificial Sequence
  CIITA targeting sequence
uugacaaacaaucuuccugc

SEQ ID NO: 46555 - RNA, 20 nt, Artificial Sequence
  CIITA targeting sequence
agguugcagugagccgugau

SEQ ID NO: 46556 - RNA, 20 nt, Artificial Sequence
  CIITA targeting sequence
acuuccuugacaaacaaucu

SEQ ID NO: 46557 - RNA, 20 nt, Artificial Sequence
  CIITA targeting sequence
cugcaaccucgacuuccuug

SEQ ID NO: 46558 - RNA, 20 nt, Artificial Sequence
  CIITA targeting sequence
cggcucacugcaaccucgac

SEQ ID NO: 46559 - RNA, 20 nt, Artificial Sequence
  CIITA targeting sequence
agccugggugacagagcaag

SEQ ID NO: 46560 - RNA, 20 nt, Artificial Sequence
  CIITA targeting sequence
cccaggcuggagugcagugg

SEQ ID NO: 46561 - RNA, 20 nt, Artificial Sequence
  CIITA targeting sequence
gucacccaggcuggagugca

SEQ ID NO: 46562 - RNA, 20 nt, Artificial Sequence
  CIITA targeting sequence
gucccuaagccuguguuugu

SEQ ID NO: 46563 - RNA, 20 nt, Artificial Sequence
  CIITA targeting sequence
cuaagccuguguuuguuucu

SEQ ID NO: 46564 - RNA, 20 nt, Artificial Sequence
  CIITA targeting sequence
gugugguggguacuaucaga

SEQ ID NO: 46565 - RNA, 20 nt, Artificial Sequence
  CIITA targeting sequence
gaggguuccccucugcugau

SEQ ID NO: 46566 - RNA, 20 nt, Artificial Sequence
  CIITA targeting sequence
gauaguacccaccacacaga

SEQ ID NO: 46567 - RNA, 20 nt, Artificial Sequence
  CIITA targeting sequence
ccucugcugaugaugcuggg

SEQ ID NO: 46568 - RNA, 20 nt, Artificial Sequence
  CIITA targeting sequence
gcugaugaugcugggggugu

SEQ ID NO: 46569 - RNA, 20 nt, Artificial Sequence
  CIITA targeting sequence
gcagaggggaacccucugau

SEQ ID NO: 46570 - RNA, 20 nt, Artificial Sequence
  CIITA targeting sequence
ucagcagaggggaacccucu

SEQ ID NO: 46571 - RNA, 20 nt, Artificial Sequence
  CIITA targeting sequence
ucuuuaugacuugcuauuaa

SEQ ID NO: 46572 - RNA, 20 nt, Artificial Sequence
  CIITA targeting sequence
uuaugacuugcuauuaaaga

SEQ ID NO: 46573 - RNA, 20 nt, Artificial Sequence
  CIITA targeting sequence
uaaagaagaacugcaaacac

SEQ ID NO: 46574 - RNA, 20 nt, Artificial Sequence
  CIITA targeting sequence
uuaauagcaagucauaaaga

SEQ ID NO: 46575 - RNA, 20 nt, Artificial Sequence
  CIITA targeting sequence
cugaaucaucagccaaugga

SEQ ID NO: 46576 - RNA, 20 nt, Artificial Sequence
  CIITA targeting sequence
gcgaccccaacucuuuaaua

SEQ ID NO: 46577 - RNA, 20 nt, Artificial Sequence
  CIITA targeting sequence
ucagccaauggaauaagcac

SEQ ID NO: 46578 - RNA, 20 nt, Artificial Sequence
  CIITA targeting sequence
gccaauggaauaagcacugg

SEQ ID NO: 46579 - RNA, 20 nt, Artificial Sequence
  CIITA targeting sequence
auuggcugaugauucagcga

SEQ ID NO: 46580 - RNA, 20 nt, Artificial Sequence
  CIITA targeting sequence
agugcuuauuccauuggcug

SEQ ID NO: 46581 - RNA, 20 nt, Artificial Sequence
  CIITA targeting sequence
uccagugcuuauuccauugg

SEQ ID NO: 46582 - RNA, 20 nt, Artificial Sequence
  CIITA targeting sequence
uacuucuuccagugcuuauu

SEQ ID NO: 46583 - RNA, 20 nt, Artificial Sequence
  CIITA targeting sequence
uugucuuacuucuuccagug

SEQ ID NO: 46584 - RNA, 20 nt, Artificial Sequence
  CIITA targeting sequence
uccuugucuuacuucuucca

SEQ ID NO: 46585 - RNA, 20 nt, Artificial Sequence
  CIITA targeting sequence
cugccagagggcaggcaagg

SEQ ID NO: 46586 - RNA, 20 nt, Artificial Sequence
  CIITA targeting sequence
gccagagggcaggcaagggu

SEQ ID NO: 46587 - RNA, 20 nt, Artificial Sequence
  CIITA targeting sequence
ggcagagaucuuccuugucu

SEQ ID NO: 46588 - RNA, 20 nt, Artificial Sequence
  CIITA targeting sequence
ugcuucagucccuccaccca

SEQ ID NO: 46589 - RNA, 20 nt, Artificial Sequence
  CIITA targeting sequence
gucccuccacccagcuagug

SEQ ID NO: 46590 - RNA, 20 nt, Artificial Sequence
  CIITA targeting sequence
cuccacccagcuagugagug

SEQ ID NO: 46591 - RNA, 20 nt, Artificial Sequence
  CIITA targeting sequence
acccagcuagugagugugug

SEQ ID NO: 46592 - RNA, 20 nt, Artificial Sequence
  CIITA targeting sequence
cuagcuggguggagggacug

SEQ ID NO: 46593 - RNA, 20 nt, Artificial Sequence
  CIITA targeting sequence
cacacucacuagcugggugg

SEQ ID NO: 46594 - RNA, 20 nt, Artificial Sequence
  CIITA targeting sequence
gaacuucuuaccugcccuca

SEQ ID NO: 46595 - RNA, 20 nt, Artificial Sequence
  CIITA targeting sequence
gagucacacacucacuagcu

SEQ ID NO: 46596 - RNA, 20 nt, Artificial Sequence
  CIITA targeting sequence
uaccugcccucacuaagccu

SEQ ID NO: 46597 - RNA, 20 nt, Artificial Sequence
  CIITA targeting sequence
cuaagccucaguuucgucau

SEQ ID NO: 46598 - RNA, 20 nt, Artificial Sequence
  CIITA targeting sequence
guuucgucauccguaauaac

SEQ ID NO: 46599 - RNA, 20 nt, Artificial Sequence
  CIITA targeting sequence
ucauccguaauaaccacccc

SEQ ID NO: 46600 - RNA, 20 nt, Artificial Sequence
  CIITA targeting sequence
uccguaauaaccaccccuga

SEQ ID NO: 46601 - RNA, 20 nt, Artificial Sequence
  CIITA targeting sequence
guaauaaccaccccugagag

SEQ ID NO: 46602 - RNA, 20 nt, Artificial Sequence
  CIITA targeting sequence
ggggugguuauuacggauga

SEQ ID NO: 46603 - RNA, 20 nt, Artificial Sequence
  CIITA targeting sequence
caggggugguuauuacggau

SEQ ID NO: 46604 - RNA, 20 nt, Artificial Sequence
  CIITA targeting sequence
gugcuuucauuuuaacaccc

SEQ ID NO: 46605 - RNA, 20 nt, Artificial Sequence
  CIITA targeting sequence
uuuuaacacccaggcgccag

SEQ ID NO: 46606 - RNA, 20 nt, Artificial Sequence
  CIITA targeting sequence
agcaaagccagaauagagaa

SEQ ID NO: 46607 - RNA, 20 nt, Artificial Sequence
  CIITA targeting sequence
ggcuuugcuagagcuggcgc

SEQ ID NO: 46608 - RNA, 20 nt, Artificial Sequence
  CIITA targeting sequence
auucuggcuuugcuagagcu

SEQ ID NO: 46609 - RNA, 20 nt, Artificial Sequence
  CIITA targeting sequence
cuauucuggcuuugcuagag

SEQ ID NO: 46610 - RNA, 20 nt, Artificial Sequence
  CIITA targeting sequence
ucccaggcgauuagcucagu

SEQ ID NO: 46611 - RNA, 20 nt, Artificial Sequence
  CIITA targeting sequence
caggcgauuagcucaguggu

SEQ ID NO: 46612 - RNA, 20 nt, Artificial Sequence
  CIITA targeting sequence
ccugggaugaaaccccuucu

SEQ ID NO: 46613 - RNA, 20 nt, Artificial Sequence
  CIITA targeting sequence
guggucuucagugaggggac

SEQ ID NO: 46614 - RNA, 20 nt, Artificial Sequence
  CIITA targeting sequence
ucagugaggggacauuuggc

SEQ ID NO: 46615 - RNA, 20 nt, Artificial Sequence
  CIITA targeting sequence
gugaggggacauuuggcauc

SEQ ID NO: 46616 - RNA, 20 nt, Artificial Sequence
  CIITA targeting sequence
cugaagaccacugagcuaau

SEQ ID NO: 46617 - RNA, 20 nt, Artificial Sequence
  CIITA targeting sequence
ccucacugaagaccacugag

SEQ ID NO: 46618 - RNA, 20 nt, Artificial Sequence
  CIITA targeting sequence
ucuaaaaacauucuuggggg

SEQ ID NO: 46619 - RNA, 20 nt, Artificial Sequence
  CIITA targeting sequence
aaaaacauucuugggggugc

SEQ ID NO: 46620 - RNA, 20 nt, Artificial Sequence
  CIITA targeting sequence
ugggggugcugcugacaucu

SEQ ID NO: 46621 - RNA, 20 nt, Artificial Sequence
  CIITA targeting sequence
gcagcacccccaagaauguu

SEQ ID NO: 46622 - RNA, 20 nt, Artificial Sequence
  CIITA targeting sequence
aguggguagaggguaggggu

SEQ ID NO: 46623 - RNA, 20 nt, Artificial Sequence
  CIITA targeting sequence
acccacuagaugucagcagc

SEQ ID NO: 46624 - RNA, 20 nt, Artificial Sequence
  CIITA targeting sequence
uuagcagcaccccuacccuc

SEQ ID NO: 46625 - RNA, 20 nt, Artificial Sequence
  CIITA targeting sequence
cuguuguggggggccugucc

SEQ ID NO: 46626 - RNA, 20 nt, Artificial Sequence
  CIITA targeting sequence
ccagugccgaggcugagaaa

SEQ ID NO: 46627 - RNA, 20 nt, Artificial Sequence
  CIITA targeting sequence
gcacuggggacaauuugggc

SEQ ID NO: 46628 - RNA, 20 nt, Artificial Sequence
  CIITA targeting sequence
gccucggcacuggggacaau

SEQ ID NO: 46629 - RNA, 20 nt, Artificial Sequence
  CIITA targeting sequence
cagccucggcacuggggaca

SEQ ID NO: 46630 - RNA, 20 nt, Artificial Sequence
  CIITA targeting sequence
uaauccuccacgcuagacug

SEQ ID NO: 46631 - RNA, 20 nt, Artificial Sequence
  CIITA targeting sequence
uccacgcuagacugcuagcu

SEQ ID NO: 46632 - RNA, 20 nt, Artificial Sequence
  CIITA targeting sequence
acgcuagacugcuagcuuug

SEQ ID NO: 46633 - RNA, 20 nt, Artificial Sequence
  CIITA targeting sequence
agcguggaggauuaggaacc

SEQ ID NO: 46634 - RNA, 20 nt, Artificial Sequence
  CIITA targeting sequence
aaggugacuucaccaagccc

SEQ ID NO: 46635 - RNA, 20 nt, Artificial Sequence
  CIITA targeting sequence
ccuuggaauaacaaagcuag

SEQ ID NO: 46636 - RNA, 20 nt, Artificial Sequence
  CIITA targeting sequence
ccaagcccgggcccugcccg

SEQ ID NO: 46637 - RNA, 20 nt, Artificial Sequence
  CIITA targeting sequence
ggcgggcagggcccgggcuu

SEQ ID NO: 46638 - RNA, 20 nt, Artificial Sequence
  CIITA targeting sequence
cccacuucuggcgggcaggg

SEQ ID NO: 46639 - RNA, 20 nt, Artificial Sequence
  CIITA targeting sequence
auaucagaggcaggcucuaa

SEQ ID NO: 46640 - RNA, 20 nt, Artificial Sequence
  CIITA targeting sequence
gaggcaggcucuaagucccc

SEQ ID NO: 46641 - RNA, 20 nt, Artificial Sequence
  CIITA targeting sequence
gauauagacauuuggccacu

SEQ ID NO: 46642 - RNA, 20 nt, Artificial Sequence
  CIITA targeting sequence
aaguccccaggacaggucug

SEQ ID NO: 46643 - RNA, 20 nt, Artificial Sequence
  CIITA targeting sequence
ccaggacaggucugaaaaaa

SEQ ID NO: 46644 - RNA, 20 nt, Artificial Sequence
  CIITA targeting sequence
uggggacuuagagccugccu

SEQ ID NO: 46645 - RNA, 20 nt, Artificial Sequence
  CIITA targeting sequence
gaaaaaagucugcagugggc

SEQ ID NO: 46646 - RNA, 20 nt, Artificial Sequence
  CIITA targeting sequence
gaccuguccuggggacuuag

SEQ ID NO: 46647 - RNA, 20 nt, Artificial Sequence
  CIITA targeting sequence
gcagugggcagaaagaggua

SEQ ID NO: 46648 - RNA, 20 nt, Artificial Sequence
  CIITA targeting sequence
gcccacugcagacuuuuuuc

SEQ ID NO: 46649 - RNA, 20 nt, Artificial Sequence
  CIITA targeting sequence
uucugcccacugcagacuuu

SEQ ID NO: 46650 - RNA, 20 nt, Artificial Sequence
  CIITA targeting sequence
accucuuucugcccacugca

SEQ ID NO: 46651 - RNA, 20 nt, Artificial Sequence
  CIITA targeting sequence
cuaccucuuucugcccacug

SEQ ID NO: 46652 - RNA, 20 nt, Artificial Sequence
  CIITA targeting sequence
ucuggccaagagggagaggu

SEQ ID NO: 46653 - RNA, 20 nt, Artificial Sequence
  CIITA targeting sequence
ggccaagagggagaggugaa

SEQ ID NO: 46654 - RNA, 20 nt, Artificial Sequence
  CIITA targeting sequence
uggccagaggaaugccacca

SEQ ID NO: 46655 - RNA, 20 nt, Artificial Sequence
  CIITA targeting sequence
cucuuggccagaggaaugcc

SEQ ID NO: 46656 - RNA, 20 nt, Artificial Sequence
  CIITA targeting sequence
cccucuuggccagaggaaug

SEQ ID NO: 46657 - RNA, 20 nt, Artificial Sequence
  CIITA targeting sequence
ccucucccucuuggccagag

SEQ ID NO: 46658 - RNA, 20 nt, Artificial Sequence
  CIITA targeting sequence
gcagcccuuucaccucuccc

SEQ ID NO: 46659 - RNA, 20 nt, Artificial Sequence
  CIITA targeting sequence
cucagcagcccuuucaccuc

SEQ ID NO: 46660 - RNA, 20 nt, Artificial Sequence
  CIITA targeting sequence
cgcagccgccgcuagguggu

SEQ ID NO: 46661 - RNA, 20 nt, Artificial Sequence
  CIITA targeting sequence
cagccgccgcuagguggugc

SEQ ID NO: 46662 - RNA, 20 nt, Artificial Sequence
  CIITA targeting sequence
gagacgccuuaugcuucccg

SEQ ID NO: 46663 - RNA, 20 nt, Artificial Sequence
  CIITA targeting sequence
gaggcagcagcaccaccuag

SEQ ID NO: 46664 - RNA, 20 nt, Artificial Sequence
  CIITA targeting sequence
cugaggcagcagcaccaccu

SEQ ID NO: 46665 - RNA, 20 nt, Artificial Sequence
  CIITA targeting sequence
cggugaccgcaaguugacaa

SEQ ID NO: 46666 - RNA, 20 nt, Artificial Sequence
  CIITA targeting sequence
ccgggaagcauaaggcgucu

SEQ ID NO: 46667 - RNA, 20 nt, Artificial Sequence
  CIITA targeting sequence
acuugcggucaccgggaagc

SEQ ID NO: 46668 - RNA, 20 nt, Artificial Sequence
  CIITA targeting sequence
gcccacauuugucaacuugc

SEQ ID NO: 46669 - RNA, 20 nt, Artificial Sequence
  CIITA targeting sequence
ugucucccuaaaugguuucc

SEQ ID NO: 46670 - RNA, 20 nt, Artificial Sequence
  CIITA targeting sequence
cccuaaaugguuucccuugu

SEQ ID NO: 46671 - RNA, 20 nt, Artificial Sequence
  CIITA targeting sequence
cuaaaugguuucccuuguua

SEQ ID NO: 46672 - RNA, 20 nt, Artificial Sequence
  CIITA targeting sequence
cuuguuaccagcgccuguuu

SEQ ID NO: 46673 - RNA, 20 nt, Artificial Sequence
  CIITA targeting sequence
cuggaugugaaaugacugcg

SEQ ID NO: 46674 - RNA, 20 nt, Artificial Sequence
  CIITA targeting sequence
agugaaacaggcgcugguaa

SEQ ID NO: 46675 - RNA, 20 nt, Artificial Sequence
  CIITA targeting sequence
cauccagugaaacaggcgcu

SEQ ID NO: 46676 - RNA, 20 nt, Artificial Sequence
  CIITA targeting sequence
uuucacauccagugaaacag

SEQ ID NO: 46677 - RNA, 20 nt, Artificial Sequence
  CIITA targeting sequence
aaaagcucugaggggaagau

SEQ ID NO: 46678 - RNA, 20 nt, Artificial Sequence
  CIITA targeting sequence
gaggggaagauccagcucag

SEQ ID NO: 46679 - RNA, 20 nt, Artificial Sequence
  CIITA targeting sequence
gagcuuuuagaaaccgcagu

SEQ ID NO: 46680 - RNA, 20 nt, Artificial Sequence
  CIITA targeting sequence
ccucagagcuuuuagaaacc

SEQ ID NO: 46681 - RNA, 20 nt, Artificial Sequence
  CIITA targeting sequence
uccccucagagcuuuuagaa

SEQ ID NO: 46682 - RNA, 20 nt, Artificial Sequence
  CIITA targeting sequence
agcucaguggcacaggcccu

SEQ ID NO: 46683 - RNA, 20 nt, Artificial Sequence
  CIITA targeting sequence
guggcacaggcccuugacuc

SEQ ID NO: 46684 - RNA, 20 nt, Artificial Sequence
  CIITA targeting sequence
agggccugugccacugagcu

SEQ ID NO: 46685 - RNA, 20 nt, Artificial Sequence
  CIITA targeting sequence
gacugaaccaggucccaggc

SEQ ID NO: 46686 - RNA, 20 nt, Artificial Sequence
  CIITA targeting sequence
gagucaagggccugugccac

SEQ ID NO: 46687 - RNA, 20 nt, Artificial Sequence
  CIITA targeting sequence
gucugagucaagggccugug

SEQ ID NO: 46688 - RNA, 20 nt, Artificial Sequence
  CIITA targeting sequence
caggcccaguucugccccac

SEQ ID NO: 46689 - RNA, 20 nt, Artificial Sequence
  CIITA targeting sequence
gccccacacuggcucccugc

SEQ ID NO: 46690 - RNA, 20 nt, Artificial Sequence
  CIITA targeting sequence
cugcacgugccuggacagug

SEQ ID NO: 46691 - RNA, 20 nt, Artificial Sequence
  CIITA targeting sequence
aggcacgugcagggagccag

SEQ ID NO: 46692 - RNA, 20 nt, Artificial Sequence
  CIITA targeting sequence
cuguccaggcacgugcaggg

SEQ ID NO: 46693 - RNA, 20 nt, Artificial Sequence
  CIITA targeting sequence
gagcugcuguuugugcaucu

SEQ ID NO: 46694 - RNA, 20 nt, Artificial Sequence
  CIITA targeting sequence
gagccuucacuguccaggca

SEQ ID NO: 46695 - RNA, 20 nt, Artificial Sequence
  CIITA targeting sequence
gucaagaggagagcacagug

SEQ ID NO: 46696 - RNA, 20 nt, Artificial Sequence
  CIITA targeting sequence
agaggagagcacaguggcug

SEQ ID NO: 46697 - RNA, 20 nt, Artificial Sequence
  CIITA targeting sequence
ugacagaugcacaaacagca

SEQ ID NO: 46698 - RNA, 20 nt, Artificial Sequence
  CIITA targeting sequence
ucuugacagaugcacaaaca

SEQ ID NO: 46699 - RNA, 20 nt, Artificial Sequence
  CIITA targeting sequence
ccucuugacagaugcacaaa

SEQ ID NO: 46700 - RNA, 20 nt, Artificial Sequence
  CIITA targeting sequence
augcugcagccacugugcuc

SEQ ID NO: 46701 - RNA, 20 nt, Artificial Sequence
  CIITA targeting sequence
cgcccagccacucuaugcug

SEQ ID NO: 46702 - RNA, 20 nt, Artificial Sequence
  CIITA targeting sequence
cgcucacgcccagccacucu

SEQ ID NO: 46703 - RNA, 20 nt, Artificial Sequence
  CIITA targeting sequence
cacgcucacgcccagccacu

SEQ ID NO: 46704 - RNA, 20 nt, Artificial Sequence
  CIITA targeting sequence
gagcgaggcacagggucugg

SEQ ID NO: 46705 - RNA, 20 nt, Artificial Sequence
  CIITA targeting sequence
gaacaccugcucucacgcuc

SEQ ID NO: 46706 - RNA, 20 nt, Artificial Sequence
  CIITA targeting sequence
cucugaacaccugcucucac

SEQ ID NO: 46707 - RNA, 20 nt, Artificial Sequence
  CIITA targeting sequence
ggcagauaggacauggccau

SEQ ID NO: 46708 - RNA, 20 nt, Artificial Sequence
  CIITA targeting sequence
gccagacccugugccucgcu

SEQ ID NO: 46709 - RNA, 20 nt, Artificial Sequence
  CIITA targeting sequence
uaucugccagacccugugcc

SEQ ID NO: 46710 - RNA, 20 nt, Artificial Sequence
  CIITA targeting sequence
guuuuauccuuuaaggcaac

SEQ ID NO: 46711 - RNA, 20 nt, Artificial Sequence
  CIITA targeting sequence
uuuaaggcaacaucacccuc

SEQ ID NO: 46712 - RNA, 20 nt, Artificial Sequence
  CIITA targeting sequence
cccucagugucccugcccug

SEQ ID NO: 46713 - RNA, 20 nt, Artificial Sequence
  CIITA targeting sequence
gugucccugcccugggaagc

SEQ ID NO: 46714 - RNA, 20 nt, Artificial Sequence
  CIITA targeting sequence
cugcccugggaagccucuca

SEQ ID NO: 46715 - RNA, 20 nt, Artificial Sequence
  CIITA targeting sequence
cagggcagggacacugaggg

SEQ ID NO: 46716 - RNA, 20 nt, Artificial Sequence
  CIITA targeting sequence
caaaguccagcuaggcacgg

SEQ ID NO: 46717 - RNA, 20 nt, Artificial Sequence
  CIITA targeting sequence
aaguccagcuaggcacgggg

SEQ ID NO: 46718 - RNA, 20 nt, Artificial Sequence
  CIITA targeting sequence
agcuaggcacggggugacug

SEQ ID NO: 46719 - RNA, 20 nt, Artificial Sequence
  CIITA targeting sequence
ccccgugccuagcuggacuu

SEQ ID NO: 46720 - RNA, 20 nt, Artificial Sequence
  CIITA targeting sequence
agucaccccgugccuagcug

SEQ ID NO: 46721 - RNA, 20 nt, Artificial Sequence
  CIITA targeting sequence
auccagucaccccgugccua

SEQ ID NO: 46722 - RNA, 20 nt, Artificial Sequence
  CIITA targeting sequence
caauccagucaccccgugcc

SEQ ID NO: 46723 - RNA, 20 nt, Artificial Sequence
  CIITA targeting sequence
ccccacccccaucucaaucc

SEQ ID NO: 46724 - RNA, 20 nt, Artificial Sequence
  CIITA targeting sequence
aaacuuacggcuuuuagagu

SEQ ID NO: 46725 - RNA, 20 nt, Artificial Sequence
  CIITA targeting sequence
aaaagccguaaguuuugauc

SEQ ID NO: 46726 - RNA, 20 nt, Artificial Sequence
  CIITA targeting sequence
cugaauuauguggcuuuuaa

SEQ ID NO: 46727 - RNA, 20 nt, Artificial Sequence
  CIITA targeting sequence
gaauuauguggcuuuuaaaa

SEQ ID NO: 46728 - RNA, 20 nt, Artificial Sequence
  CIITA targeting sequence
gagaaacacucuaaaagccg

SEQ ID NO: 46729 - RNA, 20 nt, Artificial Sequence
  CIITA targeting sequence
aguuguacacauuaaauaua

SEQ ID NO: 46730 - RNA, 20 nt, Artificial Sequence
  CIITA targeting sequence
caauguacacauuuuuuugu

SEQ ID NO: 46731 - RNA, 20 nt, Artificial Sequence
  CIITA targeting sequence
cggcaaucaagugaauuaac

SEQ ID NO: 46732 - RNA, 20 nt, Artificial Sequence
  CIITA targeting sequence
agugaauuaacauauccauc

SEQ ID NO: 46733 - RNA, 20 nt, Artificial Sequence
  CIITA targeting sequence
cuugauugccgugauuauuu

SEQ ID NO: 46734 - RNA, 20 nt, Artificial Sequence
  CIITA targeting sequence
aucaccucacuuuugugcgu

SEQ ID NO: 46735 - RNA, 20 nt, Artificial Sequence
  CIITA targeting sequence
ccucacuuuugugcgugugu

SEQ ID NO: 46736 - RNA, 20 nt, Artificial Sequence
  CIITA targeting sequence
cuuuugugcguguguguggg

SEQ ID NO: 46737 - RNA, 20 nt, Artificial Sequence
  CIITA targeting sequence
cccaaggugcacacacaacc

SEQ ID NO: 46738 - RNA, 20 nt, Artificial Sequence
  CIITA targeting sequence
ucacccaaggugcacacaca

SEQ ID NO: 46739 - RNA, 20 nt, Artificial Sequence
  CIITA targeting sequence
acugcauauuuucaucaccc

SEQ ID NO: 46740 - RNA, 20 nt, Artificial Sequence
  CIITA targeting sequence
guuagcagauuucaagucug

SEQ ID NO: 46741 - RNA, 20 nt, Artificial Sequence
  CIITA targeting sequence
gcuaacagaucuacugcaua

SEQ ID NO: 46742 - RNA, 20 nt, Artificial Sequence
  CIITA targeting sequence
agucuguaacacaguaggau

SEQ ID NO: 46743 - RNA, 20 nt, Artificial Sequence
  CIITA targeting sequence
guaacacaguaggaugaccu

SEQ ID NO: 46744 - RNA, 20 nt, Artificial Sequence
  CIITA targeting sequence
uacuguguuacagacuugaa

SEQ ID NO: 46745 - RNA, 20 nt, Artificial Sequence
  CIITA targeting sequence
uccuacuguguuacagacuu

SEQ ID NO: 46746 - RNA, 20 nt, Artificial Sequence
  CIITA targeting sequence
cugugcuguacaugagagcu

SEQ ID NO: 46747 - RNA, 20 nt, Artificial Sequence
  CIITA targeting sequence
uguacagcacagugacuaca

SEQ ID NO: 46748 - RNA, 20 nt, Artificial Sequence
  CIITA targeting sequence
cauguacagcacagugacua

SEQ ID NO: 46749 - RNA, 20 nt, Artificial Sequence
  CIITA targeting sequence
ggaacuuacucaucgugcgu

SEQ ID NO: 46750 - RNA, 20 nt, Artificial Sequence
  CIITA targeting sequence
ggagcucucauguacagcac

SEQ ID NO: 46751 - RNA, 20 nt, Artificial Sequence
  CIITA targeting sequence
ucgugcgucguacccuuuga

SEQ ID NO: 46752 - RNA, 20 nt, Artificial Sequence
  CIITA targeting sequence
ugcgucguacccuuugauca

SEQ ID NO: 46753 - RNA, 20 nt, Artificial Sequence
  CIITA targeting sequence
uacccuuugaucagcgucuc

SEQ ID NO: 46754 - RNA, 20 nt, Artificial Sequence
  CIITA targeting sequence
aaggguacgacgcacgauga

SEQ ID NO: 46755 - RNA, 20 nt, Artificial Sequence
  CIITA targeting sequence
gcgucuccccauuucccucc

SEQ ID NO: 46756 - RNA, 20 nt, Artificial Sequence
  CIITA targeting sequence
ccccauuucccuccucccca

SEQ ID NO: 46757 - RNA, 20 nt, Artificial Sequence
  CIITA targeting sequence
ccauuucccuccuccccagu

SEQ ID NO: 46758 - RNA, 20 nt, Artificial Sequence
  CIITA targeting sequence
cuccuccccagucccuggua

SEQ ID NO: 46759 - RNA, 20 nt, Artificial Sequence
  CIITA targeting sequence
uccccagucccugguaacca

SEQ ID NO: 46760 - RNA, 20 nt, Artificial Sequence
  CIITA targeting sequence
ccagucccugguaaccaccc

SEQ ID NO: 46761 - RNA, 20 nt, Artificial Sequence
  CIITA targeting sequence
cugguaaccacccuuugacu

SEQ ID NO: 46762 - RNA, 20 nt, Artificial Sequence
  CIITA targeting sequence
aagggugguuaccagggacu

SEQ ID NO: 46763 - RNA, 20 nt, Artificial Sequence
  CIITA targeting sequence
cugcuucuaugaauuugacu

SEQ ID NO: 46764 - RNA, 20 nt, Artificial Sequence
  CIITA targeting sequence
gcuucuaugaauuugacugu

SEQ ID NO: 46765 - RNA, 20 nt, Artificial Sequence
  CIITA targeting sequence
augaauuugacugucuuaga

SEQ ID NO: 46766 - RNA, 20 nt, Artificial Sequence
  CIITA targeting sequence
uagaagcagagagucaaagg

SEQ ID NO: 46767 - RNA, 20 nt, Artificial Sequence
  CIITA targeting sequence
aauucauagaagcagagagu

SEQ ID NO: 46768 - RNA, 20 nt, Artificial Sequence
  CIITA targeting sequence
uagauucucccuguaauuga

SEQ ID NO: 46769 - RNA, 20 nt, Artificial Sequence
  CIITA targeting sequence
aagacagucaaauucauaga

SEQ ID NO: 46770 - RNA, 20 nt, Artificial Sequence
  CIITA targeting sequence
cccuguaauugagaucaugc

SEQ ID NO: 46771 - RNA, 20 nt, Artificial Sequence
  CIITA targeting sequence
cuguaauugagaucaugcag

SEQ ID NO: 46772 - RNA, 20 nt, Artificial Sequence
  CIITA targeting sequence
auuacagggagaaucuaaga

SEQ ID NO: 46773 - RNA, 20 nt, Artificial Sequence
  CIITA targeting sequence
caauuacagggagaaucuaa

SEQ ID NO: 46774 - RNA, 20 nt, Artificial Sequence
  CIITA targeting sequence
ugcaguaugcguggcuuuuc

SEQ ID NO: 46775 - RNA, 20 nt, Artificial Sequence
  CIITA targeting sequence
uguccuggcaccgaaaaggg

SEQ ID NO: 46776 - RNA, 20 nt, Artificial Sequence
  CIITA targeting sequence
uggcaccgaaaagggugccc

SEQ ID NO: 46777 - RNA, 20 nt, Artificial Sequence
  CIITA targeting sequence
gugccaggacaagaaaagcc

SEQ ID NO: 46778 - RNA, 20 nt, Artificial Sequence
  CIITA targeting sequence
cacagcagggcacccuuuuc

SEQ ID NO: 46779 - RNA, 20 nt, Artificial Sequence
  CIITA targeting sequence
gccuggguuucccacagcag

SEQ ID NO: 46780 - RNA, 20 nt, Artificial Sequence
  CIITA targeting sequence
ccacagugcuuuuauaagcc

SEQ ID NO: 46781 - RNA, 20 nt, Artificial Sequence
  CIITA targeting sequence
acccuuuuugcagggcuuau

SEQ ID NO: 46782 - RNA, 20 nt, Artificial Sequence
  CIITA targeting sequence
uugcacguuuacagaacuug

SEQ ID NO: 46783 - RNA, 20 nt, Artificial Sequence
  CIITA targeting sequence
guaaacgugcaaugauuucu

SEQ ID NO: 46784 - RNA, 20 nt, Artificial Sequence
  CIITA targeting sequence
aaguucuguaaacgugcaau

SEQ ID NO: 46785 - RNA, 20 nt, Artificial Sequence
  CIITA targeting sequence
ccccuuacaaauccaaguuc

SEQ ID NO: 46786 - RNA, 20 nt, Artificial Sequence
  CIITA targeting sequence
ucaccccuuacaaauccaag

SEQ ID NO: 46787 - RNA, 20 nt, Artificial Sequence
  CIITA targeting sequence
uccucaccccuuacaaaucc

SEQ ID NO: 46788 - RNA, 20 nt, Artificial Sequence
  CIITA targeting sequence
auccuccucaccccuuacaa

SEQ ID NO: 46789 - RNA, 20 nt, Artificial Sequence
  CIITA targeting sequence
ucuauccuccucaccccuua

SEQ ID NO: 46790 - RNA, 20 nt, Artificial Sequence
  CIITA targeting sequence
aaucacagaagaaaaaaugu

SEQ ID NO: 46791 - RNA, 20 nt, Artificial Sequence
  CIITA targeting sequence
cagaagaaaaaauguccuca

SEQ ID NO: 46792 - RNA, 20 nt, Artificial Sequence
  CIITA targeting sequence
gugauuagaaaacaaaaaua

SEQ ID NO: 46793 - RNA, 20 nt, Artificial Sequence
  CIITA targeting sequence
ucugugauuagaaaacaaaa

SEQ ID NO: 46794 - RNA, 20 nt, Artificial Sequence
  CIITA targeting sequence
ucauuguuaaauaacgaaaa

SEQ ID NO: 46795 - RNA, 20 nt, Artificial Sequence
  CIITA targeting sequence
uuguuaaauaacgaaaagcc

SEQ ID NO: 46796 - RNA, 20 nt, Artificial Sequence
  CIITA targeting sequence
uuauuuaacaaugaggacau

SEQ ID NO: 46797 - RNA, 20 nt, Artificial Sequence
  CIITA targeting sequence
aacauuuggcuuuucguuau

SEQ ID NO: 46798 - RNA, 20 nt, Artificial Sequence
  CIITA targeting sequence
aguuucugcagaauucaacc

SEQ ID NO: 46799 - RNA, 20 nt, Artificial Sequence
  CIITA targeting sequence
gcagaauucaacccuaacga

SEQ ID NO: 46800 - RNA, 20 nt, Artificial Sequence
  CIITA targeting sequence
gcagaaacuugacuuuacau

SEQ ID NO: 46801 - RNA, 20 nt, Artificial Sequence
  CIITA targeting sequence
acccuaacgauccauugugc

SEQ ID NO: 46802 - RNA, 20 nt, Artificial Sequence
  CIITA targeting sequence
uuaggguugaauucugcaga

SEQ ID NO: 46803 - RNA, 20 nt, Artificial Sequence
  CIITA targeting sequence
auugugcaccagccauucug

SEQ ID NO: 46804 - RNA, 20 nt, Artificial Sequence
  CIITA targeting sequence
gcuguuugcuuuucuuuuuc

SEQ ID NO: 46805 - RNA, 20 nt, Artificial Sequence
  CIITA targeting sequence
uuuucccaccuucccagugu

SEQ ID NO: 46806 - RNA, 20 nt, Artificial Sequence
  CIITA targeting sequence
caccuucccaguguauccua

SEQ ID NO: 46807 - RNA, 20 nt, Artificial Sequence
  CIITA targeting sequence
caguguauccuagaucucau

SEQ ID NO: 46808 - RNA, 20 nt, Artificial Sequence
  CIITA targeting sequence
uagaucucauugucccguuc

SEQ ID NO: 46809 - RNA, 20 nt, Artificial Sequence
  CIITA targeting sequence
aggauacacugggaaggugg

SEQ ID NO: 46810 - RNA, 20 nt, Artificial Sequence
  CIITA targeting sequence
cauugucccguucuguaacc

SEQ ID NO: 46811 - RNA, 20 nt, Artificial Sequence
  CIITA targeting sequence
uugucccguucuguaacccu

SEQ ID NO: 46812 - RNA, 20 nt, Artificial Sequence
  CIITA targeting sequence
cguucuguaacccugccugg

SEQ ID NO: 46813 - RNA, 20 nt, Artificial Sequence
  CIITA targeting sequence
guaacccugccugguuuggu

SEQ ID NO: 46814 - RNA, 20 nt, Artificial Sequence
  CIITA targeting sequence
uaaaccaaaccaggcagggu

SEQ ID NO: 46815 - RNA, 20 nt, Artificial Sequence
  CIITA targeting sequence
auuuaaccugaccacgggca

SEQ ID NO: 46816 - RNA, 20 nt, Artificial Sequence
  CIITA targeting sequence
gguuaaauagauuauagcac

SEQ ID NO: 46817 - RNA, 20 nt, Artificial Sequence
  CIITA targeting sequence
agcuuuucacuauuacaagc

SEQ ID NO: 46818 - RNA, 20 nt, Artificial Sequence
  CIITA targeting sequence
cuauuacaagcuaccauuuc

SEQ ID NO: 46819 - RNA, 20 nt, Artificial Sequence
  CIITA targeting sequence
caaaugcaccuguugccugu

SEQ ID NO: 46820 - RNA, 20 nt, Artificial Sequence
  CIITA targeting sequence
cuaaccccaacaggcaacag

SEQ ID NO: 46821 - RNA, 20 nt, Artificial Sequence
  CIITA targeting sequence
cuuaggucacuaaccccaac

SEQ ID NO: 46822 - RNA, 20 nt, Artificial Sequence
  CIITA targeting sequence
gucacuuaggucacuaaccc

SEQ ID NO: 46823 - RNA, 20 nt, Artificial Sequence
  CIITA targeting sequence
cgagagacugagauuacgua

SEQ ID NO: 46824 - RNA, 20 nt, Artificial Sequence
  CIITA targeting sequence
ggacucugucacuuagguca

SEQ ID NO: 46825 - RNA, 20 nt, Artificial Sequence
  CIITA targeting sequence
cgggacucugucacuuaggu

SEQ ID NO: 46826 - RNA, 20 nt, Artificial Sequence
  CIITA targeting sequence
cucgggacucugucacuuag

SEQ ID NO: 46827 - RNA, 20 nt, Artificial Sequence
  CIITA targeting sequence
gucucucgggacucugucac

SEQ ID NO: 46828 - RNA, 20 nt, Artificial Sequence
  CIITA targeting sequence
cagucucucgggacucuguc

SEQ ID NO: 46829 - RNA, 20 nt, Artificial Sequence
  CIITA targeting sequence
cggguuuauuagaaaaggau

SEQ ID NO: 46830 - RNA, 20 nt, Artificial Sequence
  CIITA targeting sequence
aauaaacccgggagccugua

SEQ ID NO: 46831 - RNA, 20 nt, Artificial Sequence
  CIITA targeting sequence
uuuucuaauaaacccgggag

SEQ ID NO: 46832 - RNA, 20 nt, Artificial Sequence
  CIITA targeting sequence
gugguauccuuuucuaauaa

SEQ ID NO: 46833 - RNA, 20 nt, Artificial Sequence
  CIITA targeting sequence
gccacacagugaggggguag

SEQ ID NO: 46834 - RNA, 20 nt, Artificial Sequence
  CIITA targeting sequence
cuguguggcugacuuucugu

SEQ ID NO: 46835 - RNA, 20 nt, Artificial Sequence
  CIITA targeting sequence
acuacccccucacugugugg

SEQ ID NO: 46836 - RNA, 20 nt, Artificial Sequence
  CIITA targeting sequence
cagccugauaauagaggcac

SEQ ID NO: 46837 - RNA, 20 nt, Artificial Sequence
  CIITA targeting sequence
ggcugggauuuuucuacuac

SEQ ID NO: 46838 - RNA, 20 nt, Artificial Sequence
  CIITA targeting sequence
auuaucaggcugggauuuuu

SEQ ID NO: 46839 - RNA, 20 nt, Artificial Sequence
  CIITA targeting sequence
aacuguccuaugguggcccc

SEQ ID NO: 46840 - RNA, 20 nt, Artificial Sequence
  CIITA targeting sequence
uaugguggccccccaccacc

SEQ ID NO: 46841 - RNA, 20 nt, Artificial Sequence
  CIITA targeting sequence
gugggugguggggggccacc

SEQ ID NO: 46842 - RNA, 20 nt, Artificial Sequence
  CIITA targeting sequence
ucucuuggaggcccuggaaa

SEQ ID NO: 46843 - RNA, 20 nt, Artificial Sequence
  CIITA targeting sequence
cuuggaggcccuggaaaagu

SEQ ID NO: 46844 - RNA, 20 nt, Artificial Sequence
  CIITA targeting sequence
uggaggcccuggaaaagucc

SEQ ID NO: 46845 - RNA, 20 nt, Artificial Sequence
  CIITA targeting sequence
aagagaugacucugugggug

SEQ ID NO: 46846 - RNA, 20 nt, Artificial Sequence
  CIITA targeting sequence
agggccuccaagagaugacu

SEQ ID NO: 46847 - RNA, 20 nt, Artificial Sequence
  CIITA targeting sequence
cugcuggggaguggagggag

SEQ ID NO: 46848 - RNA, 20 nt, Artificial Sequence
  CIITA targeting sequence
ccagcagggacuuuuccagg

SEQ ID NO: 46849 - RNA, 20 nt, Artificial Sequence
  CIITA targeting sequence
acuccccagcagggacuuuu

SEQ ID NO: 46850 - RNA, 20 nt, Artificial Sequence
  CIITA targeting sequence
cuccacuccccagcagggac

SEQ ID NO: 46851 - RNA, 20 nt, Artificial Sequence
  CIITA targeting sequence
cuguuccagcuccaggguac

SEQ ID NO: 46852 - RNA, 20 nt, Artificial Sequence
  CIITA targeting sequence
agcuccaggguacagcugag

SEQ ID NO: 46853 - RNA, 20 nt, Artificial Sequence
  CIITA targeting sequence
aggguacagcugagagacuc

SEQ ID NO: 46854 - RNA, 20 nt, Artificial Sequence
  CIITA targeting sequence
gcuguacccuggagcuggaa

SEQ ID NO: 46855 - RNA, 20 nt, Artificial Sequence
  CIITA targeting sequence
cagcuguacccuggagcugg

SEQ ID NO: 46856 - RNA, 20 nt, Artificial Sequence
  CIITA targeting sequence
cucagcuguacccuggagcu

SEQ ID NO: 46857 - RNA, 20 nt, Artificial Sequence
  CIITA targeting sequence
caguugcacaucugaagcuc

SEQ ID NO: 46858 - RNA, 20 nt, Artificial Sequence
  CIITA targeting sequence
gaagcucccaguaugguguc

SEQ ID NO: 46859 - RNA, 20 nt, Artificial Sequence
  CIITA targeting sequence
gaugugcaacugugagucuc

SEQ ID NO: 46860 - RNA, 20 nt, Artificial Sequence
  CIITA targeting sequence
caguauggugucugugcugc

SEQ ID NO: 46861 - RNA, 20 nt, Artificial Sequence
  CIITA targeting sequence
gugcugcugguggucuggaa

SEQ ID NO: 46862 - RNA, 20 nt, Artificial Sequence
  CIITA targeting sequence
ggaagccacuagccagucac

SEQ ID NO: 46863 - RNA, 20 nt, Artificial Sequence
  CIITA targeting sequence
agaccaccagcagcacagac

SEQ ID NO: 46864 - RNA, 20 nt, Artificial Sequence
  CIITA targeting sequence
cagcagggcucaguaagaca

SEQ ID NO: 46865 - RNA, 20 nt, Artificial Sequence
  CIITA targeting sequence
guaagacaccccaacagcuc

SEQ ID NO: 46866 - RNA, 20 nt, Artificial Sequence
  CIITA targeting sequence
uacugagcccugcugugacu

SEQ ID NO: 46867 - RNA, 20 nt, Artificial Sequence
  CIITA targeting sequence
uuauccugccagcccauuac

SEQ ID NO: 46868 - RNA, 20 nt, Artificial Sequence
  CIITA targeting sequence
ugccagcccauuaccccucc

SEQ ID NO: 46869 - RNA, 20 nt, Artificial Sequence
  CIITA targeting sequence
cuacuucucccccagcaaga

SEQ ID NO: 46870 - RNA, 20 nt, Artificial Sequence
  CIITA targeting sequence
cccccagcaagagccagaau

SEQ ID NO: 46871 - RNA, 20 nt, Artificial Sequence
  CIITA targeting sequence
cccagcaagagccagaauga

SEQ ID NO: 46872 - RNA, 20 nt, Artificial Sequence
  CIITA targeting sequence
ugcugggggagaaguaggga

SEQ ID NO: 46873 - RNA, 20 nt, Artificial Sequence
  CIITA targeting sequence
ggcucuugcugggggagaag

SEQ ID NO: 46874 - RNA, 20 nt, Artificial Sequence
  CIITA targeting sequence
uucuggcucuugcuggggga

SEQ ID NO: 46875 - RNA, 20 nt, Artificial Sequence
  CIITA targeting sequence
gugucauucuggcucuugcu

SEQ ID NO: 46876 - RNA, 20 nt, Artificial Sequence
  CIITA targeting sequence
uucugugucauucuggcucu

SEQ ID NO: 46877 - RNA, 20 nt, Artificial Sequence
  CIITA targeting sequence
uuuucuuucugugucauucu

SEQ ID NO: 46878 - RNA, 20 nt, Artificial Sequence
  CIITA targeting sequence
ggguaucagaaucaccuggg

SEQ ID NO: 46879 - RNA, 20 nt, Artificial Sequence
  CIITA targeting sequence
gaaucaccugggugacacga

SEQ ID NO: 46880 - RNA, 20 nt, Artificial Sequence
  CIITA targeting sequence
gauacccagagcacuucuuu

SEQ ID NO: 46881 - RNA, 20 nt, Artificial Sequence
  CIITA targeting sequence
ccugggugacacgauaccca

SEQ ID NO: 46882 - RNA, 20 nt, Artificial Sequence
  CIITA targeting sequence
cccaggugauucugauaccc

SEQ ID NO: 46883 - RNA, 20 nt, Artificial Sequence
  CIITA targeting sequence
ugucacccaggugauucuga

SEQ ID NO: 46884 - RNA, 20 nt, Artificial Sequence
  CIITA targeting sequence
aacauggguaucgugucacc

SEQ ID NO: 46885 - RNA, 20 nt, Artificial Sequence
  CIITA targeting sequence
agguggauaaauaaacugug

SEQ ID NO: 46886 - RNA, 20 nt, Artificial Sequence
  CIITA targeting sequence
accuggagucuaacaugggu

SEQ ID NO: 46887 - RNA, 20 nt, Artificial Sequence
  CIITA targeting sequence
acaguuuauuuauccaccug

SEQ ID NO: 46888 - RNA, 20 nt, Artificial Sequence
  CIITA targeting sequence
gagaauguacuacuauauag

SEQ ID NO: 46889 - RNA, 20 nt, Artificial Sequence
  CIITA targeting sequence
gaauaguccacaguuuauuu

SEQ ID NO: 46890 - RNA, 20 nt, Artificial Sequence
  CIITA targeting sequence
cugaauaguccacaguuuau

SEQ ID NO: 46891 - RNA, 20 nt, Artificial Sequence
  CIITA targeting sequence
uuuuugcuauauaguaguac

SEQ ID NO: 46892 - RNA, 20 nt, Artificial Sequence
  CIITA targeting sequence
uuucuuuuuugcuauauagu

SEQ ID NO: 46893 - RNA, 20 nt, Artificial Sequence
  CIITA targeting sequence
uuuuucuuuucuuuuuugcu

SEQ ID NO: 46894 - RNA, 20 nt, Artificial Sequence
  CIITA targeting sequence
uuuuccuuuuucuuuucuuu

SEQ ID NO: 46895 - RNA, 20 nt, Artificial Sequence
  CIITA targeting sequence
uuccuuuuccuuuuucuuuu

SEQ ID NO: 46896 - RNA, 20 nt, Artificial Sequence
  CIITA targeting sequence
uucuuuccuuuuccuuuuuc

SEQ ID NO: 46897 - RNA, 20 nt, Artificial Sequence
  CIITA targeting sequence
uuccuucuuuccuuuuccuu

SEQ ID NO: 46898 - RNA, 20 nt, Artificial Sequence
  CIITA targeting sequence
agguugcuguguaugcaaug

SEQ ID NO: 46899 - RNA, 20 nt, Artificial Sequence
  CIITA targeting sequence
gaugugguaauaagcgaaag

SEQ ID NO: 46900 - RNA, 20 nt, Artificial Sequence
  CIITA targeting sequence
gagggcuuuccagguugcug

SEQ ID NO: 46901 - RNA, 20 nt, Artificial Sequence
  CIITA targeting sequence
cuuauuaccacaucugaggg

SEQ ID NO: 46902 - RNA, 20 nt, Artificial Sequence
  CIITA targeting sequence
uucgcuuauuaccacaucug

SEQ ID NO: 46903 - RNA, 20 nt, Artificial Sequence
  CIITA targeting sequence
ggccucuuucgcuuauuacc

SEQ ID NO: 46904 - RNA, 20 nt, Artificial Sequence
  CIITA targeting sequence
uaugucuggccucuuucgcu

SEQ ID NO: 46905 - RNA, 20 nt, Artificial Sequence
  CIITA targeting sequence
gcuuccauuagauaagguuc

SEQ ID NO: 46906 - RNA, 20 nt, Artificial Sequence
  CIITA targeting sequence
auuagauaagguucauggac

SEQ ID NO: 46907 - RNA, 20 nt, Artificial Sequence
  CIITA targeting sequence
aauggaagcagacaguacgc

SEQ ID NO: 46908 - RNA, 20 nt, Artificial Sequence
  CIITA targeting sequence
uggacaggcaaaacgagucu

SEQ ID NO: 46909 - RNA, 20 nt, Artificial Sequence
  CIITA targeting sequence
augaaccuuaucuaauggaa

SEQ ID NO: 46910 - RNA, 20 nt, Artificial Sequence
  CIITA targeting sequence
uuuugccuguccaugaaccu

SEQ ID NO: 46911 - RNA, 20 nt, Artificial Sequence
  CIITA targeting sequence
gaugugcuagaagcagaaua

SEQ ID NO: 46912 - RNA, 20 nt, Artificial Sequence
  CIITA targeting sequence
gacucguuuugccuguccau

SEQ ID NO: 46913 - RNA, 20 nt, Artificial Sequence
  CIITA targeting sequence
agcacaucagacucguuuug

SEQ ID NO: 46914 - RNA, 20 nt, Artificial Sequence
  CIITA targeting sequence
gcuucuagcacaucagacuc

SEQ ID NO: 46915 - RNA, 20 nt, Artificial Sequence
  CIITA targeting sequence
guacccgcuaccccaaugca

SEQ ID NO: 46916 - RNA, 20 nt, Artificial Sequence
  CIITA targeting sequence
ugccccugcccagucaguac

SEQ ID NO: 46917 - RNA, 20 nt, Artificial Sequence
  CIITA targeting sequence
ucaugccccugcccagucag

SEQ ID NO: 46918 - RNA, 20 nt, Artificial Sequence
  CIITA targeting sequence
ucuggagagcugggaauguc

SEQ ID NO: 46919 - RNA, 20 nt, Artificial Sequence
  CIITA targeting sequence
ggagagcugggaaugucaga

SEQ ID NO: 46920 - RNA, 20 nt, Artificial Sequence
  CIITA targeting sequence
agaagacuuccucaugcccc

SEQ ID NO: 46921 - RNA, 20 nt, Artificial Sequence
  CIITA targeting sequence
ccagaagacuuccucaugcc

SEQ ID NO: 46922 - RNA, 20 nt, Artificial Sequence
  CIITA targeting sequence
cagcucuccagaagacuucc

SEQ ID NO: 46923 - RNA, 20 nt, Artificial Sequence
  CIITA targeting sequence
gauuugggaucuggauggug

SEQ ID NO: 46924 - RNA, 20 nt, Artificial Sequence
  CIITA targeting sequence
gacauucccagcucuccaga

SEQ ID NO: 46925 - RNA, 20 nt, Artificial Sequence
  CIITA targeting sequence
caaaucugacauucccagcu

SEQ ID NO: 46926 - RNA, 20 nt, Artificial Sequence
  CIITA targeting sequence
ggauggugcuuacaccgugu

SEQ ID NO: 46927 - RNA, 20 nt, Artificial Sequence
  CIITA targeting sequence
agaucccaaaucugacauuc

SEQ ID NO: 46928 - RNA, 20 nt, Artificial Sequence
  CIITA targeting sequence
ucaugcugggcacuuagggu

SEQ ID NO: 46929 - RNA, 20 nt, Artificial Sequence
  CIITA targeting sequence
ugcugggcacuuaggguuau

SEQ ID NO: 46930 - RNA, 20 nt, Artificial Sequence
  CIITA targeting sequence
auguguuuuauacguagaua

SEQ ID NO: 46931 - RNA, 20 nt, Artificial Sequence
  CIITA targeting sequence
acguauaaaacacauagaua

SEQ ID NO: 46932 - RNA, 20 nt, Artificial Sequence
  CIITA targeting sequence
gguauaucuacguauaaaac

SEQ ID NO: 46933 - RNA, 20 nt, Artificial Sequence
  CIITA targeting sequence
cuuauaaaguacccagccuc

SEQ ID NO: 46934 - RNA, 20 nt, Artificial Sequence
  CIITA targeting sequence
uucccuuauaaaguacccag

SEQ ID NO: 46935 - RNA, 20 nt, Artificial Sequence
  CIITA targeting sequence
uugacuuacagcucagcacu

SEQ ID NO: 46936 - RNA, 20 nt, Artificial Sequence
  CIITA targeting sequence
augaaaccucuuucccuuau

SEQ ID NO: 46937 - RNA, 20 nt, Artificial Sequence
  CIITA targeting sequence
gcacugcuggggaggccuca

SEQ ID NO: 46938 - RNA, 20 nt, Artificial Sequence
  CIITA targeting sequence
ccagcagugcugagcuguaa

SEQ ID NO: 46939 - RNA, 20 nt, Artificial Sequence
  CIITA targeting sequence
ggaaacuuacaaucauggca

SEQ ID NO: 46940 - RNA, 20 nt, Artificial Sequence
  CIITA targeting sequence
ugaggccuccccagcagugc

SEQ ID NO: 46941 - RNA, 20 nt, Artificial Sequence
  CIITA targeting sequence
uggcagaaggugaagcaaac

SEQ ID NO: 46942 - RNA, 20 nt, Artificial Sequence
  CIITA targeting sequence
gccaugauuguaaguuuccu

SEQ ID NO: 46943 - RNA, 20 nt, Artificial Sequence
  CIITA targeting sequence
ccuucugccaugauuguaag

SEQ ID NO: 46944 - RNA, 20 nt, Artificial Sequence
  CIITA targeting sequence
uucuucacauggcaacagca

SEQ ID NO: 46945 - RNA, 20 nt, Artificial Sequence
  CIITA targeting sequence
ucacauggcaacagcaagga

SEQ ID NO: 46946 - RNA, 20 nt, Artificial Sequence
  CIITA targeting sequence
cauggcaacagcaaggagaa

SEQ ID NO: 46947 - RNA, 20 nt, Artificial Sequence
  CIITA targeting sequence
uugcuguugccaugugaaga

SEQ ID NO: 46948 - RNA, 20 nt, Artificial Sequence
  CIITA targeting sequence
ccuugcuguugccaugugaa

SEQ ID NO: 46949 - RNA, 20 nt, Artificial Sequence
  CIITA targeting sequence
ucuccuugcuguugccaugu

SEQ ID NO: 46950 - RNA, 20 nt, Artificial Sequence
  CIITA targeting sequence
uucuucuccuugcuguugcc

SEQ ID NO: 46951 - RNA, 20 nt, Artificial Sequence
  CIITA targeting sequence
gcaaagggggaagccccuua

SEQ ID NO: 46952 - RNA, 20 nt, Artificial Sequence
  CIITA targeting sequence
cccuuugcugagcacucauu

SEQ ID NO: 46953 - RNA, 20 nt, Artificial Sequence
  CIITA targeting sequence
caucucgugagaacucacua

SEQ ID NO: 46954 - RNA, 20 nt, Artificial Sequence
  CIITA targeting sequence
cgugagaacucacuaucacg

SEQ ID NO: 46955 - RNA, 20 nt, Artificial Sequence
  CIITA targeting sequence
ugagaacucacuaucacgag

SEQ ID NO: 46956 - RNA, 20 nt, Artificial Sequence
  CIITA targeting sequence
cgagaugugaugguuuugua

SEQ ID NO: 46957 - RNA, 20 nt, Artificial Sequence
  CIITA targeting sequence
cacgagaugugaugguuuug

SEQ ID NO: 46958 - RNA, 20 nt, Artificial Sequence
  CIITA targeting sequence
cuaucacgagaacaggaugg

SEQ ID NO: 46959 - RNA, 20 nt, Artificial Sequence
  CIITA targeting sequence
cgagaacaggaugggggaaa

SEQ ID NO: 46960 - RNA, 20 nt, Artificial Sequence
  CIITA targeting sequence
ugauagugaguucucacgag

SEQ ID NO: 46961 - RNA, 20 nt, Artificial Sequence
  CIITA targeting sequence
cgugauagugaguucucacg

SEQ ID NO: 46962 - RNA, 20 nt, Artificial Sequence
  CIITA targeting sequence
uguucucgugauagugaguu

SEQ ID NO: 46963 - RNA, 20 nt, Artificial Sequence
  CIITA targeting sequence
cccauccuguucucgugaua

SEQ ID NO: 46964 - RNA, 20 nt, Artificial Sequence
  CIITA targeting sequence
ugggggugguuucccccauc

SEQ ID NO: 46965 - RNA, 20 nt, Artificial Sequence
  CIITA targeting sequence
auuaucuccaccugaucccu

SEQ ID NO: 46966 - RNA, 20 nt, Artificial Sequence
  CIITA targeting sequence
ccaccugaucccucccacaa

SEQ ID NO: 46967 - RNA, 20 nt, Artificial Sequence
  CIITA targeting sequence
accugaucccucccacaaca

SEQ ID NO: 46968 - RNA, 20 nt, Artificial Sequence
  CIITA targeting sequence
gguggagauaauugaaucau

SEQ ID NO: 46969 - RNA, 20 nt, Artificial Sequence
  CIITA targeting sequence
cucccacaacacguggggau

SEQ ID NO: 46970 - RNA, 20 nt, Artificial Sequence
  CIITA targeting sequence
cacaacacguggggauuaug

SEQ ID NO: 46971 - RNA, 20 nt, Artificial Sequence
  CIITA targeting sequence
ccacguguugugggagggau

SEQ ID NO: 46972 - RNA, 20 nt, Artificial Sequence
  CIITA targeting sequence
cauaauccccacguguugug

SEQ ID NO: 46973 - RNA, 20 nt, Artificial Sequence
  CIITA targeting sequence
agaugagacuuaguugggga

SEQ ID NO: 46974 - RNA, 20 nt, Artificial Sequence
  CIITA targeting sequence
ugaauuguaguucccauaau

SEQ ID NO: 46975 - RNA, 20 nt, Artificial Sequence
  CIITA targeting sequence
ucuugaauuguaguucccau

SEQ ID NO: 46976 - RNA, 20 nt, Artificial Sequence
  CIITA targeting sequence
caucuugaauuguaguuccc

SEQ ID NO: 46977 - RNA, 20 nt, Artificial Sequence
  CIITA targeting sequence
ccaacuaagucucaucuuga

SEQ ID NO: 46978 - RNA, 20 nt, Artificial Sequence
  CIITA targeting sequence
uacauauauguguguguaua

SEQ ID NO: 46979 - RNA, 20 nt, Artificial Sequence
  CIITA targeting sequence
acauaugucaagcuguccac

SEQ ID NO: 46980 - RNA, 20 nt, Artificial Sequence
  CIITA targeting sequence
agcuguccacuuaggauuug

SEQ ID NO: 46981 - RNA, 20 nt, Artificial Sequence
  CIITA targeting sequence
acuuaggauuugugauauac

SEQ ID NO: 46982 - RNA, 20 nt, Artificial Sequence
  CIITA targeting sequence
uaaguggacagcuugacaua

SEQ ID NO: 46983 - RNA, 20 nt, Artificial Sequence
  CIITA targeting sequence
caaauccuaaguggacagcu

SEQ ID NO: 46984 - RNA, 20 nt, Artificial Sequence
  CIITA targeting sequence
uuaaaaacauuaagauuccu

SEQ ID NO: 46985 - RNA, 20 nt, Artificial Sequence
  CIITA targeting sequence
uaauguuuuuaaagaugggg

SEQ ID NO: 46986 - RNA, 20 nt, Artificial Sequence
  CIITA targeting sequence
uaagauucugccuuagaccc

SEQ ID NO: 46987 - RNA, 20 nt, Artificial Sequence
  CIITA targeting sequence
uaggaaucuuaauguuuuua

SEQ ID NO: 46988 - RNA, 20 nt, Artificial Sequence
  CIITA targeting sequence
gccuuagacccauugacucc

SEQ ID NO: 46989 - RNA, 20 nt, Artificial Sequence
  CIITA targeting sequence
aaggcagaaucuuaggaauc

SEQ ID NO: 46990 - RNA, 20 nt, Artificial Sequence
  CIITA targeting sequence
augggucuaaggcagaaucu

SEQ ID NO: 46991 - RNA, 20 nt, Artificial Sequence
  CIITA targeting sequence
uugcuuggagggauccccaa

SEQ ID NO: 46992 - RNA, 20 nt, Artificial Sequence
  CIITA targeting sequence
ugggugaagaggaaauaaac

SEQ ID NO: 46993 - RNA, 20 nt, Artificial Sequence
  CIITA targeting sequence
guccuggaauaugguagaga

SEQ ID NO: 46994 - RNA, 20 nt, Artificial Sequence
  CIITA targeting sequence
uggaauaugguagagauuuu

SEQ ID NO: 46995 - RNA, 20 nt, Artificial Sequence
  CIITA targeting sequence
aggacugaaaacaguugcuc

SEQ ID NO: 46996 - RNA, 20 nt, Artificial Sequence
  CIITA targeting sequence
accauauuccaggacugaaa

SEQ ID NO: 46997 - RNA, 20 nt, Artificial Sequence
  CIITA targeting sequence
cuaccauauuccaggacuga

SEQ ID NO: 46998 - RNA, 20 nt, Artificial Sequence
  CIITA targeting sequence
uuguuuguuuuguuuuuaga

SEQ ID NO: 46999 - RNA, 20 nt, Artificial Sequence
  CIITA targeting sequence
aaaaacaaaacaaacaaaga

SEQ ID NO: 47000 - RNA, 20 nt, Artificial Sequence
  CIITA targeting sequence
cuaaaaacaaaacaaacaaa

SEQ ID NO: 47001 - RNA, 20 nt, Artificial Sequence
  CIITA targeting sequence
cacccugucgccuaggcuag

SEQ ID NO: 47002 - RNA, 20 nt, Artificial Sequence
  CIITA targeting sequence
cccugucgccuaggcuaguc

SEQ ID NO: 47003 - RNA, 20 nt, Artificial Sequence
  CIITA targeting sequence
ccuaggcuagucuccaguga

SEQ ID NO: 47004 - RNA, 20 nt, Artificial Sequence
  CIITA targeting sequence
ccagugauacgaucauggcu

SEQ ID NO: 47005 - RNA, 20 nt, Artificial Sequence
  CIITA targeting sequence
agugauacgaucauggcuca

SEQ ID NO: 47006 - RNA, 20 nt, Artificial Sequence
  CIITA targeting sequence
cuggagacuagccuaggcga

SEQ ID NO: 47007 - RNA, 20 nt, Artificial Sequence
  CIITA targeting sequence
uaucacuggagacuagccua

SEQ ID NO: 47008 - RNA, 20 nt, Artificial Sequence
  CIITA targeting sequence
uggcucacugcagccuugaa

SEQ ID NO: 47009 - RNA, 20 nt, Artificial Sequence
  CIITA targeting sequence
ugcuggaggaaagauaagcc

SEQ ID NO: 47010 - RNA, 20 nt, Artificial Sequence
  CIITA targeting sequence
cccucuagauuauuugcucu

SEQ ID NO: 47011 - RNA, 20 nt, Artificial Sequence
  CIITA targeting sequence
cucuagauuauuugcucuca

SEQ ID NO: 47012 - RNA, 20 nt, Artificial Sequence
  CIITA targeting sequence
agauuauuugcucucaaaua

SEQ ID NO: 47013 - RNA, 20 nt, Artificial Sequence
  CIITA targeting sequence
agagggagaaaaaaacaaaa

SEQ ID NO: 47014 - RNA, 20 nt, Artificial Sequence
  CIITA targeting sequence
caaauaacuacguaaauucu

SEQ ID NO: 47015 - RNA, 20 nt, Artificial Sequence
  CIITA targeting sequence
aauaacuacguaaauucuau

SEQ ID NO: 47016 - RNA, 20 nt, Artificial Sequence
  CIITA targeting sequence
aucaucguucauaaauuuga

SEQ ID NO: 47017 - RNA, 20 nt, Artificial Sequence
  CIITA targeting sequence
ucguucauaaauuugacuuu

SEQ ID NO: 47018 - RNA, 20 nt, Artificial Sequence
  CIITA targeting sequence
uucauaaauuugacuuuucu

SEQ ID NO: 47019 - RNA, 20 nt, Artificial Sequence
  CIITA targeting sequence
uaaauuugacuuuucugaug

SEQ ID NO: 47020 - RNA, 20 nt, Artificial Sequence
  CIITA targeting sequence
aauuuaugaacgaugauaga

SEQ ID NO: 47021 - RNA, 20 nt, Artificial Sequence
  CIITA targeting sequence
gaugaggagauuauggccua

SEQ ID NO: 47022 - RNA, 20 nt, Artificial Sequence
  CIITA targeting sequence
gaaaagucaaauuuaugaac

SEQ ID NO: 47023 - RNA, 20 nt, Artificial Sequence
  CIITA targeting sequence
ucagaaaagucaaauuuaug

SEQ ID NO: 47024 - RNA, 20 nt, Artificial Sequence
  CIITA targeting sequence
ucaucagaaaagucaaauuu

SEQ ID NO: 47025 - RNA, 20 nt, Artificial Sequence
  CIITA targeting sequence
ccucaucagaaaagucaaau

SEQ ID NO: 47026 - RNA, 20 nt, Artificial Sequence
  CIITA targeting sequence
uuccugaaaacacuuucguu

SEQ ID NO: 47027 - RNA, 20 nt, Artificial Sequence
  CIITA targeting sequence
ugaaaacacuuucguuaaaa

SEQ ID NO: 47028 - RNA, 20 nt, Artificial Sequence
  CIITA targeting sequence
ggaacgauauauaauaggcc

SEQ ID NO: 47029 - RNA, 20 nt, Artificial Sequence
  CIITA targeting sequence
uuaaaacucaacaaccacac

SEQ ID NO: 47030 - RNA, 20 nt, Artificial Sequence
  CIITA targeting sequence
acaaccacacuguccauuuc

SEQ ID NO: 47031 - RNA, 20 nt, Artificial Sequence
  CIITA targeting sequence
auuucuuuuauaaugaggua

SEQ ID NO: 47032 - RNA, 20 nt, Artificial Sequence
  CIITA targeting sequence
uuuauaaugagguaaguaau

SEQ ID NO: 47033 - RNA, 20 nt, Artificial Sequence
  CIITA targeting sequence
uuauaaaagaaauggacagu

SEQ ID NO: 47034 - RNA, 20 nt, Artificial Sequence
  CIITA targeting sequence
ggcaauuacuuaccucauua

SEQ ID NO: 47035 - RNA, 20 nt, Artificial Sequence
  CIITA targeting sequence
auuaaaaaaauguaauucuu

SEQ ID NO: 47036 - RNA, 20 nt, Artificial Sequence
  CIITA targeting sequence
uuguagagacagggucuuac

SEQ ID NO: 47037 - RNA, 20 nt, Artificial Sequence
  CIITA targeting sequence
acaaagaauuacauuuuuuu

SEQ ID NO: 47038 - RNA, 20 nt, Artificial Sequence
  CIITA targeting sequence
cuacaaagaauuacauuuuu

SEQ ID NO: 47039 - RNA, 20 nt, Artificial Sequence
  CIITA targeting sequence
uacuauguuucccagguugg

SEQ ID NO: 47040 - RNA, 20 nt, Artificial Sequence
  CIITA targeting sequence
cagguuggccuugaacuucc

SEQ ID NO: 47041 - RNA, 20 nt, Artificial Sequence
  CIITA targeting sequence
gggcugguuuugucacuucc

SEQ ID NO: 47042 - RNA, 20 nt, Artificial Sequence
  CIITA targeting sequence
cuucccugcugugucaccuu

SEQ ID NO: 47043 - RNA, 20 nt, Artificial Sequence
  CIITA targeting sequence
cugcugugucaccuuaagga

SEQ ID NO: 47044 - RNA, 20 nt, Artificial Sequence
  CIITA targeting sequence
ccuuaaggaagucccagucc

SEQ ID NO: 47045 - RNA, 20 nt, Artificial Sequence
  CIITA targeting sequence
uuaaggugacacagcaggga

SEQ ID NO: 47046 - RNA, 20 nt, Artificial Sequence
  CIITA targeting sequence
cagucccuuucugaaccuca

SEQ ID NO: 47047 - RNA, 20 nt, Artificial Sequence
  CIITA targeting sequence
cuuucugaaccucaguuucc

SEQ ID NO: 47048 - RNA, 20 nt, Artificial Sequence
  CIITA targeting sequence
gaaccucaguuuccucaucu

SEQ ID NO: 47049 - RNA, 20 nt, Artificial Sequence
  CIITA targeting sequence
gaaagggacugggacuuccu

SEQ ID NO: 47050 - RNA, 20 nt, Artificial Sequence
  CIITA targeting sequence
guuuccucaucugagaaaug

SEQ ID NO: 47051 - RNA, 20 nt, Artificial Sequence
  CIITA targeting sequence
ucaucugagaaauggggaua

SEQ ID NO: 47052 - RNA, 20 nt, Artificial Sequence
  CIITA targeting sequence
ucugagaaauggggauaaga

SEQ ID NO: 47053 - RNA, 20 nt, Artificial Sequence
  CIITA targeting sequence
gagaaauggggauaagaaua

SEQ ID NO: 47054 - RNA, 20 nt, Artificial Sequence
  CIITA targeting sequence
gaugaggaaacugagguuca

SEQ ID NO: 47055 - RNA, 20 nt, Artificial Sequence
  CIITA targeting sequence
cagaugaggaaacugagguu

SEQ ID NO: 47056 - RNA, 20 nt, Artificial Sequence
  CIITA targeting sequence
ccauuucucagaugaggaaa

SEQ ID NO: 47057 - RNA, 20 nt, Artificial Sequence
  CIITA targeting sequence
uauccccauuucucagauga

SEQ ID NO: 47058 - RNA, 20 nt, Artificial Sequence
  CIITA targeting sequence
uguaggguuauuagggguua

SEQ ID NO: 47059 - RNA, 20 nt, Artificial Sequence
  CIITA targeting sequence
acaauagcaacgucuaugcu

SEQ ID NO: 47060 - RNA, 20 nt, Artificial Sequence
  CIITA targeting sequence
uaucaacaauagcaacgucu

SEQ ID NO: 47061 - RNA, 20 nt, Artificial Sequence
  CIITA targeting sequence
cugacauucuuugggagaau

SEQ ID NO: 47062 - RNA, 20 nt, Artificial Sequence
  CIITA targeting sequence
gggacauuaucuuaucaaca

SEQ ID NO: 47063 - RNA, 20 nt, Artificial Sequence
  CIITA targeting sequence
uugggagaauuauuaaaaug

SEQ ID NO: 47064 - RNA, 20 nt, Artificial Sequence
  CIITA targeting sequence
caaagaaugucagggacauu

SEQ ID NO: 47065 - RNA, 20 nt, Artificial Sequence
  CIITA targeting sequence
cccaaagaaugucagggaca

SEQ ID NO: 47066 - RNA, 20 nt, Artificial Sequence
  CIITA targeting sequence
uuuuaauaauucucccaaag

SEQ ID NO: 47067 - RNA, 20 nt, Artificial Sequence
  CIITA targeting sequence
ucagguucaaccccucaugg

SEQ ID NO: 47068 - RNA, 20 nt, Artificial Sequence
  CIITA targeting sequence
gguucaaccccucaugguca

SEQ ID NO: 47069 - RNA, 20 nt, Artificial Sequence
  CIITA targeting sequence
accccucauggucacagguu

SEQ ID NO: 47070 - RNA, 20 nt, Artificial Sequence
  CIITA targeting sequence
uggucacagguuggcugcca

SEQ ID NO: 47071 - RNA, 20 nt, Artificial Sequence
  CIITA targeting sequence
cagguuggcugccacugcca

SEQ ID NO: 47072 - RNA, 20 nt, Artificial Sequence
  CIITA targeting sequence
ggcauuuuggcaguggcagc

SEQ ID NO: 47073 - RNA, 20 nt, Artificial Sequence
  CIITA targeting sequence
ucaggcauuuuggcaguggc

SEQ ID NO: 47074 - RNA, 20 nt, Artificial Sequence
  CIITA targeting sequence
caucaggcauuuuggcagug

SEQ ID NO: 47075 - RNA, 20 nt, Artificial Sequence
  CIITA targeting sequence
cuucccuucuugugucccuu

SEQ ID NO: 47076 - RNA, 20 nt, Artificial Sequence
  CIITA targeting sequence
cuucuugugucccuuuuuaa

SEQ ID NO: 47077 - RNA, 20 nt, Artificial Sequence
  CIITA targeting sequence
ugugucccuuuuuaacuucc

SEQ ID NO: 47078 - RNA, 20 nt, Artificial Sequence
  CIITA targeting sequence
cuuuuuaacuuccaaagaaa

SEQ ID NO: 47079 - RNA, 20 nt, Artificial Sequence
  CIITA targeting sequence
aaagaaaacuuucucagaag

SEQ ID NO: 47080 - RNA, 20 nt, Artificial Sequence
  CIITA targeting sequence
uuggaaguuaaaaagggaca

SEQ ID NO: 47081 - RNA, 20 nt, Artificial Sequence
  CIITA targeting sequence
cagaagguucucaccagccu

SEQ ID NO: 47082 - RNA, 20 nt, Artificial Sequence
  CIITA targeting sequence
gaagguucucaccagccuuc

SEQ ID NO: 47083 - RNA, 20 nt, Artificial Sequence
  CIITA targeting sequence
gagaaaguuuucuuuggaag

SEQ ID NO: 47084 - RNA, 20 nt, Artificial Sequence
  CIITA targeting sequence
caccagccuuccccucaugu

SEQ ID NO: 47085 - RNA, 20 nt, Artificial Sequence
  CIITA targeting sequence
ccagccuuccccucauguuu

SEQ ID NO: 47086 - RNA, 20 nt, Artificial Sequence
  CIITA targeting sequence
ccucauguuucccugcaucc

SEQ ID NO: 47087 - RNA, 20 nt, Artificial Sequence
  CIITA targeting sequence
uguuucccugcaucccacug

SEQ ID NO: 47088 - RNA, 20 nt, Artificial Sequence
  CIITA targeting sequence
cugcaucccacugaguacuu

SEQ ID NO: 47089 - RNA, 20 nt, Artificial Sequence
  CIITA targeting sequence
uuauuucuuuuguuuuagca

SEQ ID NO: 47090 - RNA, 20 nt, Artificial Sequence
  CIITA targeting sequence
uuuguuuuagcacaccaaug

SEQ ID NO: 47091 - RNA, 20 nt, Artificial Sequence
  CIITA targeting sequence
uuggugugcuaaaacaaaag

SEQ ID NO: 47092 - RNA, 20 nt, Artificial Sequence
  CIITA targeting sequence
guguacagggcaaagucauu

SEQ ID NO: 47093 - RNA, 20 nt, Artificial Sequence
  CIITA targeting sequence
aguuuuucaaccacccugaa

SEQ ID NO: 47094 - RNA, 20 nt, Artificial Sequence
  CIITA targeting sequence
accacccugaaagcaugguu

SEQ ID NO: 47095 - RNA, 20 nt, Artificial Sequence
  CIITA targeting sequence
gggugguugaaaaacuugau

SEQ ID NO: 47096 - RNA, 20 nt, Artificial Sequence
  CIITA targeting sequence
aaccaugcuuucaggguggu

SEQ ID NO: 47097 - RNA, 20 nt, Artificial Sequence
  CIITA targeting sequence
uacagcaauucuaaccaugc

SEQ ID NO: 47098 - RNA, 20 nt, Artificial Sequence
  CIITA targeting sequence
aaguuaugguucuuacagca

SEQ ID NO: 47099 - RNA, 20 nt, Artificial Sequence
  CIITA targeting sequence
auaaagguaaguguccucau

SEQ ID NO: 47100 - RNA, 20 nt, Artificial Sequence
  CIITA targeting sequence
ucaugggcuugugucucggc

SEQ ID NO: 47101 - RNA, 20 nt, Artificial Sequence
  CIITA targeting sequence
ugggcuugugucucggcuga

SEQ ID NO: 47102 - RNA, 20 nt, Artificial Sequence
  CIITA targeting sequence
cggcugauuucugacuuggc

SEQ ID NO: 47103 - RNA, 20 nt, Artificial Sequence
  CIITA targeting sequence
gcugauuucugacuuggcag

SEQ ID NO: 47104 - RNA, 20 nt, Artificial Sequence
  CIITA targeting sequence
gccgagacacaagcccauga

SEQ ID NO: 47105 - RNA, 20 nt, Artificial Sequence
  CIITA targeting sequence
gacuuggcagcaagcacuca

SEQ ID NO: 47106 - RNA, 20 nt, Artificial Sequence
  CIITA targeting sequence
gaaaucagccgagacacaag

SEQ ID NO: 47107 - RNA, 20 nt, Artificial Sequence
  CIITA targeting sequence
cauugugaacagcagggggc

SEQ ID NO: 47108 - RNA, 20 nt, Artificial Sequence
  CIITA targeting sequence
caaugugacaugcuuuuaua

SEQ ID NO: 47109 - RNA, 20 nt, Artificial Sequence
  CIITA targeting sequence
caacaggcugcaaagcccag

SEQ ID NO: 47110 - RNA, 20 nt, Artificial Sequence
  CIITA targeting sequence
cagggacucacuccagccua

SEQ ID NO: 47111 - RNA, 20 nt, Artificial Sequence
  CIITA targeting sequence
gggacucacuccagccuagc

SEQ ID NO: 47112 - RNA, 20 nt, Artificial Sequence
  CIITA targeting sequence
cugagaagcccccacccuca

SEQ ID NO: 47113 - RNA, 20 nt, Artificial Sequence
  CIITA targeting sequence
cuccagccuagcacugggcu

SEQ ID NO: 47114 - RNA, 20 nt, Artificial Sequence
  CIITA targeting sequence
agccuagcacugggcuuaca

SEQ ID NO: 47115 - RNA, 20 nt, Artificial Sequence
  CIITA targeting sequence
uaaauuuaauguaagcccag

SEQ ID NO: 47116 - RNA, 20 nt, Artificial Sequence
  CIITA targeting sequence
aagagcccaacuggacccac

SEQ ID NO: 47117 - RNA, 20 nt, Artificial Sequence
  CIITA targeting sequence
uagaaagguucuuaaauuua

SEQ ID NO: 47118 - RNA, 20 nt, Artificial Sequence
  CIITA targeting sequence
gcugccuccugcucuguuuu

SEQ ID NO: 47119 - RNA, 20 nt, Artificial Sequence
  CIITA targeting sequence
ugcucuguuuucuccugucu

SEQ ID NO: 47120 - RNA, 20 nt, Artificial Sequence
  CIITA targeting sequence
guuuucuccugucuccuucu

SEQ ID NO: 47121 - RNA, 20 nt, Artificial Sequence
  CIITA targeting sequence
ccugucuccuucuaaccuua

SEQ ID NO: 47122 - RNA, 20 nt, Artificial Sequence
  CIITA targeting sequence
ugucuccuucuaaccuuauc

SEQ ID NO: 47123 - RNA, 20 nt, Artificial Sequence
  CIITA targeting sequence
ccuucuaaccuuaucucucu

SEQ ID NO: 47124 - RNA, 20 nt, Artificial Sequence
  CIITA targeting sequence
uucuaaccuuaucucucugu

SEQ ID NO: 47125 - RNA, 20 nt, Artificial Sequence
  CIITA targeting sequence
aaccuuaucucucugugcag

SEQ ID NO: 47126 - RNA, 20 nt, Artificial Sequence
  CIITA targeting sequence
cucugugcagaugccuccca

SEQ ID NO: 47127 - RNA, 20 nt, Artificial Sequence
  CIITA targeting sequence
cugugcagaugccucccacc

SEQ ID NO: 47128 - RNA, 20 nt, Artificial Sequence
  CIITA targeting sequence
gugcagaugccucccacccu

SEQ ID NO: 47129 - RNA, 20 nt, Artificial Sequence
  CIITA targeting sequence
gcacagagagauaagguuag

SEQ ID NO: 47130 - RNA, 20 nt, Artificial Sequence
  CIITA targeting sequence
cacccuagucucucucccuc

SEQ ID NO: 47131 - RNA, 20 nt, Artificial Sequence
  CIITA targeting sequence
cucucccucugagcagcucu

SEQ ID NO: 47132 - RNA, 20 nt, Artificial Sequence
  CIITA targeting sequence
cucccucugagcagcucucu

SEQ ID NO: 47133 - RNA, 20 nt, Artificial Sequence
  CIITA targeting sequence
cccucugagcagcucucuca

SEQ ID NO: 47134 - RNA, 20 nt, Artificial Sequence
  CIITA targeting sequence
cucugagcagcucucucacc

SEQ ID NO: 47135 - RNA, 20 nt, Artificial Sequence
  CIITA targeting sequence
gagcagcucucucaccuucc

SEQ ID NO: 47136 - RNA, 20 nt, Artificial Sequence
  CIITA targeting sequence
gagggagagagacuagggug

SEQ ID NO: 47137 - RNA, 20 nt, Artificial Sequence
  CIITA targeting sequence
cucaccuucccagguccuaa

SEQ ID NO: 47138 - RNA, 20 nt, Artificial Sequence
  CIITA targeting sequence
caccuucccagguccuaacc

SEQ ID NO: 47139 - RNA, 20 nt, Artificial Sequence
  CIITA targeting sequence
ccuucccagguccuaacccu

SEQ ID NO: 47140 - RNA, 20 nt, Artificial Sequence
  CIITA targeting sequence
cagguccuaacccuguuaac

SEQ ID NO: 47141 - RNA, 20 nt, Artificial Sequence
  CIITA targeting sequence
uaacccuguuaacuguuguc

SEQ ID NO: 47142 - RNA, 20 nt, Artificial Sequence
  CIITA targeting sequence
guuuuuugcuuuuccuucaa

SEQ ID NO: 47143 - RNA, 20 nt, Artificial Sequence
  CIITA targeting sequence
uucaaugacgauuccugugu

SEQ ID NO: 47144 - RNA, 20 nt, Artificial Sequence
  CIITA targeting sequence
augacgauuccuguguuccu

SEQ ID NO: 47145 - RNA, 20 nt, Artificial Sequence
  CIITA targeting sequence
uugaaggaaaagcaaaaaac

SEQ ID NO: 47146 - RNA, 20 nt, Artificial Sequence
  CIITA targeting sequence
ucauugaaggaaaagcaaaa

SEQ ID NO: 47147 - RNA, 20 nt, Artificial Sequence
  CIITA targeting sequence
uguguuccuuauuccagugu

SEQ ID NO: 47148 - RNA, 20 nt, Artificial Sequence
  CIITA targeting sequence
uuauuccagugucauguaag

SEQ ID NO: 47149 - RNA, 20 nt, Artificial Sequence
  CIITA targeting sequence
agugucauguaaguuauuaa

SEQ ID NO: 47150 - RNA, 20 nt, Artificial Sequence
  CIITA targeting sequence
uguaaguuauuaaccucugg

SEQ ID NO: 47151 - RNA, 20 nt, Artificial Sequence
  CIITA targeting sequence
gguuuucugcuuucuuaauc

SEQ ID NO: 47152 - RNA, 20 nt, Artificial Sequence
  CIITA targeting sequence
gcuuucuuaaucuacccuua

SEQ ID NO: 47153 - RNA, 20 nt, Artificial Sequence
  CIITA targeting sequence
uaaucuacccuuauauguaa

SEQ ID NO: 47154 - RNA, 20 nt, Artificial Sequence
  CIITA targeting sequence
acccuuauauguaaauaccu

SEQ ID NO: 47155 - RNA, 20 nt, Artificial Sequence
  CIITA targeting sequence
agcaagguauuuacauauaa

SEQ ID NO: 47156 - RNA, 20 nt, Artificial Sequence
  CIITA targeting sequence
caagcaagguauuuacauau

SEQ ID NO: 47157 - RNA, 20 nt, Artificial Sequence
  CIITA targeting sequence
caguguagucuagcucaguc

SEQ ID NO: 47158 - RNA, 20 nt, Artificial Sequence
  CIITA targeting sequence
guguagucuagcucagucug

SEQ ID NO: 47159 - RNA, 20 nt, Artificial Sequence
  CIITA targeting sequence
uaagaacugccuugaugacu

SEQ ID NO: 47160 - RNA, 20 nt, Artificial Sequence
  CIITA targeting sequence
uaugauauuuuauacuuaaa

SEQ ID NO: 47161 - RNA, 20 nt, Artificial Sequence
  CIITA targeting sequence
aggcaguucuuaugauauuu

SEQ ID NO: 47162 - RNA, 20 nt, Artificial Sequence
  CIITA targeting sequence
ucaaggcaguucuuaugaua

SEQ ID NO: 47163 - RNA, 20 nt, Artificial Sequence
  CIITA targeting sequence
uaaaacuauagucaucaagg

SEQ ID NO: 47164 - RNA, 20 nt, Artificial Sequence
  CIITA targeting sequence
uauucauaaaacuauaguca

SEQ ID NO: 47165 - RNA, 20 nt, Artificial Sequence
  CIITA targeting sequence
aggaaagacagacaauuuca

SEQ ID NO: 47166 - RNA, 20 nt, Artificial Sequence
  CIITA targeting sequence
uggaaauacuuaaaaauguu

SEQ ID NO: 47167 - RNA, 20 nt, Artificial Sequence
  CIITA targeting sequence
uuccuggaaauacuuaaaaa

SEQ ID NO: 47168 - RNA, 20 nt, Artificial Sequence
  CIITA targeting sequence
gucuuuccuggaaauacuua

SEQ ID NO: 47169 - RNA, 20 nt, Artificial Sequence
  CIITA targeting sequence
gauuauagcagagggcuuuu

SEQ ID NO: 47170 - RNA, 20 nt, Artificial Sequence
  CIITA targeting sequence
gaaauugucugucuuuccug

SEQ ID NO: 47171 - RNA, 20 nt, Artificial Sequence
  CIITA targeting sequence
gcuauaaucugaaauugucu

SEQ ID NO: 47172 - RNA, 20 nt, Artificial Sequence
  CIITA targeting sequence
uugugguuuuuggguuuugc

SEQ ID NO: 47173 - RNA, 20 nt, Artificial Sequence
  CIITA targeting sequence
uccccaaguuauuuuuggua

SEQ ID NO: 47174 - RNA, 20 nt, Artificial Sequence
  CIITA targeting sequence
ccaaguuauuuuugguagcu

SEQ ID NO: 47175 - RNA, 20 nt, Artificial Sequence
  CIITA targeting sequence
agcuaccaaaaauaacuugg

SEQ ID NO: 47176 - RNA, 20 nt, Artificial Sequence
  CIITA targeting sequence
ucugugaauuuucucagugg

SEQ ID NO: 47177 - RNA, 20 nt, Artificial Sequence
  CIITA targeting sequence
gugaauuuucucaguggaua

SEQ ID NO: 47178 - RNA, 20 nt, Artificial Sequence
  CIITA targeting sequence
cagaagaaaaaaaaagucaa

SEQ ID NO: 47179 - RNA, 20 nt, Artificial Sequence
  CIITA targeting sequence
caguggauaaccaggccaug

SEQ ID NO: 47180 - RNA, 20 nt, Artificial Sequence
  CIITA targeting sequence
guggauaaccaggccaugcu

SEQ ID NO: 47181 - RNA, 20 nt, Artificial Sequence
  CIITA targeting sequence
acugagaaaauucacagaag

SEQ ID NO: 47182 - RNA, 20 nt, Artificial Sequence
  CIITA targeting sequence
gagauaaaacugcuguuccu

SEQ ID NO: 47183 - RNA, 20 nt, Artificial Sequence
  CIITA targeting sequence
gauguagugcagcauggccu

SEQ ID NO: 47184 - RNA, 20 nt, Artificial Sequence
  CIITA targeting sequence
cggauguagugcagcauggc

SEQ ID NO: 47185 - RNA, 20 nt, Artificial Sequence
  CIITA targeting sequence
uuacuucuccaauuuggucu

SEQ ID NO: 47186 - RNA, 20 nt, Artificial Sequence
  CIITA targeting sequence
ccaauuuggucugguucauu

SEQ ID NO: 47187 - RNA, 20 nt, Artificial Sequence
  CIITA targeting sequence
aauuuggucugguucauugg

SEQ ID NO: 47188 - RNA, 20 nt, Artificial Sequence
  CIITA targeting sequence
gguucauugggagccaugug

SEQ ID NO: 47189 - RNA, 20 nt, Artificial Sequence
  CIITA targeting sequence
uugggagccaugugaucgaa

SEQ ID NO: 47190 - RNA, 20 nt, Artificial Sequence
  CIITA targeting sequence
caaugaaccagaccaaauug

SEQ ID NO: 47191 - RNA, 20 nt, Artificial Sequence
  CIITA targeting sequence
cauggcucccaaugaaccag

SEQ ID NO: 47192 - RNA, 20 nt, Artificial Sequence
  CIITA targeting sequence
aacucgaugacugcgugcag

SEQ ID NO: 47193 - RNA, 20 nt, Artificial Sequence
  CIITA targeting sequence
aucacauggcucccaaugaa

SEQ ID NO: 47194 - RNA, 20 nt, Artificial Sequence
  CIITA targeting sequence
augacugcgugcagacugau

SEQ ID NO: 47195 - RNA, 20 nt, Artificial Sequence
  CIITA targeting sequence
aguucgaucacauggcuccc

SEQ ID NO: 47196 - RNA, 20 nt, Artificial Sequence
  CIITA targeting sequence
ucgaguucgaucacauggcu

SEQ ID NO: 47197 - RNA, 20 nt, Artificial Sequence
  CIITA targeting sequence
gcacgcagucaucgaguucg

SEQ ID NO: 47198 - RNA, 20 nt, Artificial Sequence
  CIITA targeting sequence
gucugcacgcagucaucgag

SEQ ID NO: 47199 - RNA, 20 nt, Artificial Sequence
  CIITA targeting sequence
ucagucugcacgcagucauc

SEQ ID NO: 47200 - RNA, 20 nt, Artificial Sequence
  CIITA targeting sequence
ucaucagucugcacgcaguc

SEQ ID NO: 47201 - RNA, 20 nt, Artificial Sequence
  CIITA targeting sequence
cuuacuccucaucagucugc

SEQ ID NO: 47202 - RNA, 20 nt, Artificial Sequence
  CIITA targeting sequence
guagauagacagggugguua

SEQ ID NO: 47203 - RNA, 20 nt, Artificial Sequence
  CIITA targeting sequence
acugaguggcccugggggug

SEQ ID NO: 47204 - RNA, 20 nt, Artificial Sequence
  CIITA targeting sequence
aucuacugaguggcccuggg

SEQ ID NO: 47205 - RNA, 20 nt, Artificial Sequence
  CIITA targeting sequence
ucuacgccacaccaaguguc

SEQ ID NO: 47206 - RNA, 20 nt, Artificial Sequence
  CIITA targeting sequence
aaagcauuaugccuagugaa

SEQ ID NO: 47207 - RNA, 20 nt, Artificial Sequence
  CIITA targeting sequence
cuaggcauaaugcuuuugag

SEQ ID NO: 47208 - RNA, 20 nt, Artificial Sequence
  CIITA targeting sequence
gggcauuucacuaggcauaa

SEQ ID NO: 47209 - RNA, 20 nt, Artificial Sequence
  CIITA targeting sequence
ccuauucugggcauuucacu

SEQ ID NO: 47210 - RNA, 20 nt, Artificial Sequence
  CIITA targeting sequence
auaggggcagaaaguagauu

SEQ ID NO: 47211 - RNA, 20 nt, Artificial Sequence
  CIITA targeting sequence
gccccuauagauucaccuau

SEQ ID NO: 47212 - RNA, 20 nt, Artificial Sequence
  CIITA targeting sequence
acuuucugccccuauagauu

SEQ ID NO: 47213 - RNA, 20 nt, Artificial Sequence
  CIITA targeting sequence
ugguuuccuagggcuaggau

SEQ ID NO: 47214 - RNA, 20 nt, Artificial Sequence
  CIITA targeting sequence
uggaugcgagacauaaugag

SEQ ID NO: 47215 - RNA, 20 nt, Artificial Sequence
  CIITA targeting sequence
augacuguuuaaauccauaa

SEQ ID NO: 47216 - RNA, 20 nt, Artificial Sequence
  CIITA targeting sequence
cauccaugacuguuuaaauc

SEQ ID NO: 47217 - RNA, 20 nt, Artificial Sequence
  CIITA targeting sequence
cgcauccaugacuguuuaaa

SEQ ID NO: 47218 - RNA, 20 nt, Artificial Sequence
  CIITA targeting sequence
uuaugucucgcauccaugac

SEQ ID NO: 47219 - RNA, 20 nt, Artificial Sequence
  CIITA targeting sequence
cauuaugucucgcauccaug

SEQ ID NO: 47220 - RNA, 20 nt, Artificial Sequence
  CIITA targeting sequence
auaguuaagugucucauuau

SEQ ID NO: 47221 - RNA, 20 nt, Artificial Sequence
  CIITA targeting sequence
uucuauaguuaagugucuca

SEQ ID NO: 47222 - RNA, 20 nt, Artificial Sequence
  CIITA targeting sequence
uugcuuguauaacuuuguuc

SEQ ID NO: 47223 - RNA, 20 nt, Artificial Sequence
  CIITA targeting sequence
uuuccuugcuuguauaacuu

SEQ ID NO: 47224 - RNA, 20 nt, Artificial Sequence
  CIITA targeting sequence
uaguccucuauuuggcucca

SEQ ID NO: 47225 - RNA, 20 nt, Artificial Sequence
  CIITA targeting sequence
ucuauuuggcuccacaggga

SEQ ID NO: 47226 - RNA, 20 nt, Artificial Sequence
  CIITA targeting sequence
auuuggcuccacagggaaug

SEQ ID NO: 47227 - RNA, 20 nt, Artificial Sequence
  CIITA targeting sequence
acagggaauguuaugacauc

SEQ ID NO: 47228 - RNA, 20 nt, Artificial Sequence
  CIITA targeting sequence
agugaucugcccgccucagc

SEQ ID NO: 47229 - RNA, 20 nt, Artificial Sequence
  CIITA targeting sequence
uggccucaagugaucugccc

SEQ ID NO: 47230 - RNA, 20 nt, Artificial Sequence
  CIITA targeting sequence
acuccuggccucaagugauc

SEQ ID NO: 47231 - RNA, 20 nt, Artificial Sequence
  CIITA targeting sequence
ucaacuccuggccucaagug

SEQ ID NO: 47232 - RNA, 20 nt, Artificial Sequence
  CIITA targeting sequence
cuacuaaaaauacaaaaauu

SEQ ID NO: 47233 - RNA, 20 nt, Artificial Sequence
  CIITA targeting sequence
acuaaaaauacaaaaauuag

SEQ ID NO: 47234 - RNA, 20 nt, Artificial Sequence
  CIITA targeting sequence
ggcuaauuuuuguauuuuua

SEQ ID NO: 47235 - RNA, 20 nt, Artificial Sequence
  CIITA targeting sequence
uuuuucuuuucuuuuuugag

SEQ ID NO: 47236 - RNA, 20 nt, Artificial Sequence
  CIITA targeting sequence
uuucuuuuuugagauggagu

SEQ ID NO: 47237 - RNA, 20 nt, Artificial Sequence
  CIITA targeting sequence
uuuuugagauggagucuugc

SEQ ID NO: 47238 - RNA, 20 nt, Artificial Sequence
  CIITA targeting sequence
aaaaagaaaagaaaaaagau

SEQ ID NO: 47239 - RNA, 20 nt, Artificial Sequence
  CIITA targeting sequence
caaaaaagaaaagaaaaaag

SEQ ID NO: 47240 - RNA, 20 nt, Artificial Sequence
  CIITA targeting sequence
aucucaaaaaagaaaagaaa

SEQ ID NO: 47241 - RNA, 20 nt, Artificial Sequence
  CIITA targeting sequence
ugcucugucacccaggcugg

SEQ ID NO: 47242 - RNA, 20 nt, Artificial Sequence
  CIITA targeting sequence
gucacccaggcuggagugca

SEQ ID NO: 47243 - RNA, 20 nt, Artificial Sequence
  CIITA targeting sequence
cccaggcuggagugcaauag

SEQ ID NO: 47244 - RNA, 20 nt, Artificial Sequence
  CIITA targeting sequence
agccugggugacagagcaag

SEQ ID NO: 47245 - RNA, 20 nt, Artificial Sequence
  CIITA targeting sequence
uggcucacugcaacccaauc

SEQ ID NO: 47246 - RNA, 20 nt, Artificial Sequence
  CIITA targeting sequence
cgaacuccugaccuaaagca

SEQ ID NO: 47247 - RNA, 20 nt, Artificial Sequence
  CIITA targeting sequence
aacuccugaccuaaagcaau

SEQ ID NO: 47248 - RNA, 20 nt, Artificial Sequence
  CIITA targeting sequence
agaccagccuggccaacaug

SEQ ID NO: 47249 - RNA, 20 nt, Artificial Sequence
  CIITA targeting sequence
ugaccuaaagcaaucugccu

SEQ ID NO: 47250 - RNA, 20 nt, Artificial Sequence
  CIITA targeting sequence
ggaguucgagaccagccugg

SEQ ID NO: 47251 - RNA, 20 nt, Artificial Sequence
  CIITA targeting sequence
gccugccuuggccucccaaa

SEQ ID NO: 47252 - RNA, 20 nt, Artificial Sequence
  CIITA targeting sequence
caaagugcugggauuacaga

SEQ ID NO: 47253 - RNA, 20 nt, Artificial Sequence
  CIITA targeting sequence
cagcacuuugggaggccaag

SEQ ID NO: 47254 - RNA, 20 nt, Artificial Sequence
  CIITA targeting sequence
guaaucccagcacuuuggga

SEQ ID NO: 47255 - RNA, 20 nt, Artificial Sequence
  CIITA targeting sequence
ugucuguaaucccagcacuu

SEQ ID NO: 47256 - RNA, 20 nt, Artificial Sequence
  CIITA targeting sequence
gcugggugcaguggcucaug

SEQ ID NO: 47257 - RNA, 20 nt, Artificial Sequence
  CIITA targeting sequence
uaccacuuugggaggccgag

SEQ ID NO: 47258 - RNA, 20 nt, Artificial Sequence
  CIITA targeting sequence
caaagugguaggauuacagg

SEQ ID NO: 47259 - RNA, 20 nt, Artificial Sequence
  CIITA targeting sequence
gccucccaaagugguaggau

SEQ ID NO: 47260 - RNA, 20 nt, Artificial Sequence
  CIITA targeting sequence
gccucggccucccaaagugg

SEQ ID NO: 47261 - RNA, 20 nt, Artificial Sequence
  CIITA targeting sequence
uucugccucggccucccaaa

SEQ ID NO: 47262 - RNA, 20 nt, Artificial Sequence
  CIITA targeting sequence
cuugaguccaggaguuugag

SEQ ID NO: 47263 - RNA, 20 nt, Artificial Sequence
  CIITA targeting sequence
agugauccuucugccucggc

SEQ ID NO: 47264 - RNA, 20 nt, Artificial Sequence
  CIITA targeting sequence
aggaguuugagaccagcgug

SEQ ID NO: 47265 - RNA, 20 nt, Artificial Sequence
  CIITA targeting sequence
uggacucaagugauccuucu

SEQ ID NO: 47266 - RNA, 20 nt, Artificial Sequence
  CIITA targeting sequence
aacuccuggacucaagugau

SEQ ID NO: 47267 - RNA, 20 nt, Artificial Sequence
  CIITA targeting sequence
caaacuccuggacucaagug

SEQ ID NO: 47268 - RNA, 20 nt, Artificial Sequence
  CIITA targeting sequence
ccauguugcccacgcugguc

SEQ ID NO: 47269 - RNA, 20 nt, Artificial Sequence
  CIITA targeting sequence
caccauguugcccacgcugg

SEQ ID NO: 47270 - RNA, 20 nt, Artificial Sequence
  CIITA targeting sequence
acccucuaugaaaaauuuuu

SEQ ID NO: 47271 - RNA, 20 nt, Artificial Sequence
  CIITA targeting sequence
aacccaccacuaacaaauau

SEQ ID NO: 47272 - RNA, 20 nt, Artificial Sequence
  CIITA targeting sequence
caaacccaccacuaacaaau

SEQ ID NO: 47273 - RNA, 20 nt, Artificial Sequence
  CIITA targeting sequence
aagucucaaacccaccacua

SEQ ID NO: 47274 - RNA, 20 nt, Artificial Sequence
  CIITA targeting sequence
auuugcuuuuauauuuuaau

SEQ ID NO: 47275 - RNA, 20 nt, Artificial Sequence
  CIITA targeting sequence
aaaaugaucaucuaucaguu

SEQ ID NO: 47276 - RNA, 20 nt, Artificial Sequence
  CIITA targeting sequence
uuuuugacaacagcaaauua

SEQ ID NO: 47277 - RNA, 20 nt, Artificial Sequence
  CIITA targeting sequence
ucuaucaguuggguaauaac

SEQ ID NO: 47278 - RNA, 20 nt, Artificial Sequence
  CIITA targeting sequence
aucaguuggguaauaacaac

SEQ ID NO: 47279 - RNA, 20 nt, Artificial Sequence
  CIITA targeting sequence
ggaggccugcuuuucucuuu

SEQ ID NO: 47280 - RNA, 20 nt, Artificial Sequence
  CIITA targeting sequence
agagccguggccaccccagu

SEQ ID NO: 47281 - RNA, 20 nt, Artificial Sequence
  CIITA targeting sequence
cuuuagaacuccucuggagc

SEQ ID NO: 47282 - RNA, 20 nt, Artificial Sequence
  CIITA targeting sequence
uuagaacuccucuggagcau

SEQ ID NO: 47283 - RNA, 20 nt, Artificial Sequence
  CIITA targeting sequence
aaagagaaaagcaggccucc

SEQ ID NO: 47284 - RNA, 20 nt, Artificial Sequence
  CIITA targeting sequence
ucuggagcauuuuaauuaca

SEQ ID NO: 47285 - RNA, 20 nt, Artificial Sequence
  CIITA targeting sequence
ggagcauuuuaauuacagug

SEQ ID NO: 47286 - RNA, 20 nt, Artificial Sequence
  CIITA targeting sequence
agaggaguucuaaagagaaa

SEQ ID NO: 47287 - RNA, 20 nt, Artificial Sequence
  CIITA targeting sequence
acuguaauuaaaaugcucca

SEQ ID NO: 47288 - RNA, 20 nt, Artificial Sequence
  CIITA targeting sequence
auuagugcugcuuaucuggg

SEQ ID NO: 47289 - RNA, 20 nt, Artificial Sequence
  CIITA targeting sequence
ggggagccaggggaucuugc

SEQ ID NO: 47290 - RNA, 20 nt, Artificial Sequence
  CIITA targeting sequence
ccagauaagcagcacuaaug

SEQ ID NO: 47291 - RNA, 20 nt, Artificial Sequence
  CIITA targeting sequence
ccuggcuccccagauaagca

SEQ ID NO: 47292 - RNA, 20 nt, Artificial Sequence
  CIITA targeting sequence
ugccacaguggcuaguagcu

SEQ ID NO: 47293 - RNA, 20 nt, Artificial Sequence
  CIITA targeting sequence
aaggcuccuaguguuggccu

SEQ ID NO: 47294 - RNA, 20 nt, Artificial Sequence
  CIITA targeting sequence
uaguguuggccuccaggcug

SEQ ID NO: 47295 - RNA, 20 nt, Artificial Sequence
  CIITA targeting sequence
aggcugagguggucauuucu

SEQ ID NO: 47296 - RNA, 20 nt, Artificial Sequence
  CIITA targeting sequence
gccuggaggccaacacuagg

SEQ ID NO: 47297 - RNA, 20 nt, Artificial Sequence
  CIITA targeting sequence
uuucuccuggcaggcaucgg

SEQ ID NO: 47298 - RNA, 20 nt, Artificial Sequence
  CIITA targeting sequence
ccuggcaggcaucggaaucg

SEQ ID NO: 47299 - RNA, 20 nt, Artificial Sequence
  CIITA targeting sequence
uggcaggcaucggaaucggg

SEQ ID NO: 47300 - RNA, 20 nt, Artificial Sequence
  CIITA targeting sequence
gaaucgggguaaacugagug

SEQ ID NO: 47301 - RNA, 20 nt, Artificial Sequence
  CIITA targeting sequence
gaugccugccaggagaaaug

SEQ ID NO: 47302 - RNA, 20 nt, Artificial Sequence
  CIITA targeting sequence
ggguaaacugagugaucugg

SEQ ID NO: 47303 - RNA, 20 nt, Artificial Sequence
  CIITA targeting sequence
guuuaccccgauuccgaugc

SEQ ID NO: 47304 - RNA, 20 nt, Artificial Sequence
  CIITA targeting sequence
cucaguuuaccccgauuccg

SEQ ID NO: 47305 - RNA, 20 nt, Artificial Sequence
  CIITA targeting sequence
gguggcagagcaccuagacc

SEQ ID NO: 47306 - RNA, 20 nt, Artificial Sequence
  CIITA targeting sequence
gccaccagaucacucaguuu

SEQ ID NO: 47307 - RNA, 20 nt, Artificial Sequence
  CIITA targeting sequence
aggugcucugccaccagauc

SEQ ID NO: 47308 - RNA, 20 nt, Artificial Sequence
  CIITA targeting sequence
caaugacauccugaucauca

SEQ ID NO: 47309 - RNA, 20 nt, Artificial Sequence
  CIITA targeting sequence
augacauccugaucaucaac

SEQ ID NO: 47310 - RNA, 20 nt, Artificial Sequence
  CIITA targeting sequence
uugagauagugcaggugguc

SEQ ID NO: 47311 - RNA, 20 nt, Artificial Sequence
  CIITA targeting sequence
ugaucaucaacugugaguuc

SEQ ID NO: 47312 - RNA, 20 nt, Artificial Sequence
  CIITA targeting sequence
ggaugucauugagauagugc

SEQ ID NO: 47313 - RNA, 20 nt, Artificial Sequence
  CIITA targeting sequence
ucaacugugaguuccucaac

SEQ ID NO: 47314 - RNA, 20 nt, Artificial Sequence
  CIITA targeting sequence
acugugaguuccucaacgau

SEQ ID NO: 47315 - RNA, 20 nt, Artificial Sequence
  CIITA targeting sequence
caguugaugaucaggauguc

SEQ ID NO: 47316 - RNA, 20 nt, Artificial Sequence
  CIITA targeting sequence
ucaacgaugugcucacugac

SEQ ID NO: 47317 - RNA, 20 nt, Artificial Sequence
  CIITA targeting sequence
acgaugugcucacugaccac

SEQ ID NO: 47318 - RNA, 20 nt, Artificial Sequence
  CIITA targeting sequence
uugaggaacucacaguugau

SEQ ID NO: 47319 - RNA, 20 nt, Artificial Sequence
  CIITA targeting sequence
cugaccaccugcucaacagg

SEQ ID NO: 47320 - RNA, 20 nt, Artificial Sequence
  CIITA targeting sequence
gugagcacaucguugaggaa

SEQ ID NO: 47321 - RNA, 20 nt, Artificial Sequence
  CIITA targeting sequence
acaggcucuuccugccccuc

SEQ ID NO: 47322 - RNA, 20 nt, Artificial Sequence
  CIITA targeting sequence
uccugccccucuacguguac

SEQ ID NO: 47323 - RNA, 20 nt, Artificial Sequence
  CIITA targeting sequence
ugccccucuacguguacuca

SEQ ID NO: 47324 - RNA, 20 nt, Artificial Sequence
  CIITA targeting sequence
acguguacucacuggagaac

SEQ ID NO: 47325 - RNA, 20 nt, Artificial Sequence
  CIITA targeting sequence
cuggagaaccaggacaaggu

SEQ ID NO: 47326 - RNA, 20 nt, Artificial Sequence
  CIITA targeting sequence
agugaguacacguagagggg

SEQ ID NO: 47327 - RNA, 20 nt, Artificial Sequence
  CIITA targeting sequence
ccagugaguacacguagagg

SEQ ID NO: 47328 - RNA, 20 nt, Artificial Sequence
  CIITA targeting sequence
ugguucuccagugaguacac

SEQ ID NO: 47329 - RNA, 20 nt, Artificial Sequence
  CIITA targeting sequence
agccccguggcucccgcugg

SEQ ID NO: 47330 - RNA, 20 nt, Artificial Sequence
  CIITA targeting sequence
cgcuggcugaaggccaucag

SEQ ID NO: 47331 - RNA, 20 nt, Artificial Sequence
  CIITA targeting sequence
gccagcgggagccacggggc

SEQ ID NO: 47332 - RNA, 20 nt, Artificial Sequence
  CIITA targeting sequence
gaaguggggaagaacagucc

SEQ ID NO: 47333 - RNA, 20 nt, Artificial Sequence
  CIITA targeting sequence
gucucaggaaauaagaggaa

SEQ ID NO: 47334 - RNA, 20 nt, Artificial Sequence
  CIITA targeting sequence
cugucucaggaaauaagagg

SEQ ID NO: 47335 - RNA, 20 nt, Artificial Sequence
  CIITA targeting sequence
gucucugucucaggaaauaa

SEQ ID NO: 47336 - RNA, 20 nt, Artificial Sequence
  CIITA targeting sequence
cacacacacacucugucucu

SEQ ID NO: 47337 - RNA, 20 nt, Artificial Sequence
  CIITA targeting sequence
cacacacacacacucugucu

SEQ ID NO: 47338 - RNA, 20 nt, Artificial Sequence
  CIITA targeting sequence
ucucacacacacacacucug

SEQ ID NO: 47339 - RNA, 20 nt, Artificial Sequence
  CIITA targeting sequence
cuuuuauagucuucucacac

SEQ ID NO: 47340 - RNA, 20 nt, Artificial Sequence
  CIITA targeting sequence
uucacuuuuauagucuucuc

SEQ ID NO: 47341 - RNA, 20 nt, Artificial Sequence
  CIITA targeting sequence
cauucacuuuuauagucuuc

SEQ ID NO: 47342 - RNA, 20 nt, Artificial Sequence
  CIITA targeting sequence
uuucucauucacuuuuauag

SEQ ID NO: 47343 - RNA, 20 nt, Artificial Sequence
  CIITA targeting sequence
guaaucuuuucucauucacu

SEQ ID NO: 47344 - RNA, 20 nt, Artificial Sequence
  CIITA targeting sequence
ggaggaaacaggaaacaucu

SEQ ID NO: 47345 - RNA, 20 nt, Artificial Sequence
  CIITA targeting sequence
ugaugucgguaaucuuuucu

SEQ ID NO: 47346 - RNA, 20 nt, Artificial Sequence
  CIITA targeting sequence
uccugaugucgguaaucuuu

SEQ ID NO: 47347 - RNA, 20 nt, Artificial Sequence
  CIITA targeting sequence
uguuuccuccugaugucggu

SEQ ID NO: 47348 - RNA, 20 nt, Artificial Sequence
  CIITA targeting sequence
gaaucaccugagggauaggu

SEQ ID NO: 47349 - RNA, 20 nt, Artificial Sequence
  CIITA targeting sequence
gugcugcugguucucagggc

SEQ ID NO: 47350 - RNA, 20 nt, Artificial Sequence
  CIITA targeting sequence
cagggccccccugugaggaa

SEQ ID NO: 47351 - RNA, 20 nt, Artificial Sequence
  CIITA targeting sequence
gggccccccugugaggaaug

SEQ ID NO: 47352 - RNA, 20 nt, Artificial Sequence
  CIITA targeting sequence
caggggggcccugagaacca

SEQ ID NO: 47353 - RNA, 20 nt, Artificial Sequence
  CIITA targeting sequence
ucacaggggggcccugagaa

SEQ ID NO: 47354 - RNA, 20 nt, Artificial Sequence
  CIITA targeting sequence
ggaggggaggccucugugca

SEQ ID NO: 47355 - RNA, 20 nt, Artificial Sequence
  CIITA targeting sequence
agaagcagcauuccucacag

SEQ ID NO: 47356 - RNA, 20 nt, Artificial Sequence
  CIITA targeting sequence
ccuccagaagcagcauuccu

SEQ ID NO: 47357 - RNA, 20 nt, Artificial Sequence
  CIITA targeting sequence
gugcaguuccuccggaggua

SEQ ID NO: 47358 - RNA, 20 nt, Artificial Sequence
  CIITA targeting sequence
uuuguaccagcuggggcacu

SEQ ID NO: 47359 - RNA, 20 nt, Artificial Sequence
  CIITA targeting sequence
uuaaguuaccaagcacguuc

SEQ ID NO: 47360 - RNA, 20 nt, Artificial Sequence
  CIITA targeting sequence
cgugggucagccucucaucc

SEQ ID NO: 47361 - RNA, 20 nt, Artificial Sequence
  CIITA targeting sequence
ugggucagccucucauccgu

SEQ ID NO: 47362 - RNA, 20 nt, Artificial Sequence
  CIITA targeting sequence
gccucucauccgugaguaau

SEQ ID NO: 47363 - RNA, 20 nt, Artificial Sequence
  CIITA targeting sequence
cauccgugaguaauggugaa

SEQ ID NO: 47364 - RNA, 20 nt, Artificial Sequence
  CIITA targeting sequence
uccgugaguaauggugaaag

SEQ ID NO: 47365 - RNA, 20 nt, Artificial Sequence
  CIITA targeting sequence
gugaguaauggugaaagguu

SEQ ID NO: 47366 - RNA, 20 nt, Artificial Sequence
  CIITA targeting sequence
cggaugagaggcugacccac

SEQ ID NO: 47367 - RNA, 20 nt, Artificial Sequence
  CIITA targeting sequence
ggucacacaagcgagcagca

SEQ ID NO: 47368 - RNA, 20 nt, Artificial Sequence
  CIITA targeting sequence
cucucucucucuccugccac

SEQ ID NO: 47369 - RNA, 20 nt, Artificial Sequence
  CIITA targeting sequence
cucucucucuccugccaccc

SEQ ID NO: 47370 - RNA, 20 nt, Artificial Sequence
  CIITA targeting sequence
cucucucuccugccacccug

SEQ ID NO: 47371 - RNA, 20 nt, Artificial Sequence
  CIITA targeting sequence
cucucuccugccacccugca

SEQ ID NO: 47372 - RNA, 20 nt, Artificial Sequence
  CIITA targeting sequence
cucuccugccacccugcacu

SEQ ID NO: 47373 - RNA, 20 nt, Artificial Sequence
  CIITA targeting sequence
cuccugccacccugcacuag

SEQ ID NO: 47374 - RNA, 20 nt, Artificial Sequence
  CIITA targeting sequence
ccugccacccugcacuaggg

SEQ ID NO: 47375 - RNA, 20 nt, Artificial Sequence
  CIITA targeting sequence
ugccacccugcacuagggag

SEQ ID NO: 47376 - RNA, 20 nt, Artificial Sequence
  CIITA targeting sequence
cuagugcaggguggcaggag

SEQ ID NO: 47377 - RNA, 20 nt, Artificial Sequence
  CIITA targeting sequence
ucccuagugcaggguggcag

SEQ ID NO: 47378 - RNA, 20 nt, Artificial Sequence
  CIITA targeting sequence
ccucccuagugcaggguggc

SEQ ID NO: 47379 - RNA, 20 nt, Artificial Sequence
  CIITA targeting sequence
gccguucuccucccuagugc

SEQ ID NO: 47380 - RNA, 20 nt, Artificial Sequence
  CIITA targeting sequence
cuuuaucuucugucacaggu

SEQ ID NO: 47381 - RNA, 20 nt, Artificial Sequence
  CIITA targeting sequence
uuaucuucugucacagguau

SEQ ID NO: 47382 - RNA, 20 nt, Artificial Sequence
  CIITA targeting sequence
ucugucacagguaugcuuga

SEQ ID NO: 47383 - RNA, 20 nt, Artificial Sequence
  CIITA targeting sequence
gucacagguaugcuugauca

SEQ ID NO: 47384 - RNA, 20 nt, Artificial Sequence
  CIITA targeting sequence
cagguaugcuugaucauuca

SEQ ID NO: 47385 - RNA, 20 nt, Artificial Sequence
  CIITA targeting sequence
agcauaccugugacagaaga

SEQ ID NO: 47386 - RNA, 20 nt, Artificial Sequence
  CIITA targeting sequence
uucaccaauguccccacuac

SEQ ID NO: 47387 - RNA, 20 nt, Artificial Sequence
  CIITA targeting sequence
ccaauguccccacuacauuu

SEQ ID NO: 47388 - RNA, 20 nt, Artificial Sequence
  CIITA targeting sequence
ccacuacauuuggggucccu

SEQ ID NO: 47389 - RNA, 20 nt, Artificial Sequence
  CIITA targeting sequence
cgguucuaguucccagauua

SEQ ID NO: 47390 - RNA, 20 nt, Artificial Sequence
  CIITA targeting sequence
aguucccagauuaccgugug

SEQ ID NO: 47391 - RNA, 20 nt, Artificial Sequence
  CIITA targeting sequence
cagauuaccguguggaagga

SEQ ID NO: 47392 - RNA, 20 nt, Artificial Sequence
  CIITA targeting sequence
gggaacuagaaccgcgauaa

SEQ ID NO: 47393 - RNA, 20 nt, Artificial Sequence
  CIITA targeting sequence
acacgguaaucugggaacua

SEQ ID NO: 47394 - RNA, 20 nt, Artificial Sequence
  CIITA targeting sequence
uuccacacgguaaucuggga

SEQ ID NO: 47395 - RNA, 20 nt, Artificial Sequence
  CIITA targeting sequence
uguagcaaccuuagcucuca

SEQ ID NO: 47396 - RNA, 20 nt, Artificial Sequence
  CIITA targeting sequence
cagauuugugucuugagcca

SEQ ID NO: 47397 - RNA, 20 nt, Artificial Sequence
  CIITA targeting sequence
gauuugugucuugagccaau

SEQ ID NO: 47398 - RNA, 20 nt, Artificial Sequence
  CIITA targeting sequence
gagagcuaagguugcuacaa

SEQ ID NO: 47399 - RNA, 20 nt, Artificial Sequence
  CIITA targeting sequence
ugagccaauuuaucucccuc

SEQ ID NO: 47400 - RNA, 20 nt, Artificial Sequence
  CIITA targeting sequence
agacacaaaucugagagcua

SEQ ID NO: 47401 - RNA, 20 nt, Artificial Sequence
  CIITA targeting sequence
cccuccccuccuucaacaag

SEQ ID NO: 47402 - RNA, 20 nt, Artificial Sequence
  CIITA targeting sequence
cuccccuccuucaacaagug

SEQ ID NO: 47403 - RNA, 20 nt, Artificial Sequence
  CIITA targeting sequence
ccuccuucaacaaguguguu

SEQ ID NO: 47404 - RNA, 20 nt, Artificial Sequence
  CIITA targeting sequence
uucaacaaguguguuuccuu

SEQ ID NO: 47405 - RNA, 20 nt, Artificial Sequence
  CIITA targeting sequence
acaaguguguuuccuucaug

SEQ ID NO: 47406 - RNA, 20 nt, Artificial Sequence
  CIITA targeting sequence
uucauguaauuauguaauau

SEQ ID NO: 47407 - RNA, 20 nt, Artificial Sequence
  CIITA targeting sequence
uguaauuauguaauauuuac

SEQ ID NO: 47408 - RNA, 20 nt, Artificial Sequence
  CIITA targeting sequence
uguaaauauuacauaauuac

SEQ ID NO: 47409 - RNA, 20 nt, Artificial Sequence
  CIITA targeting sequence
cuucuuguaaauauuacaua

SEQ ID NO: 47410 - RNA, 20 nt, Artificial Sequence
  CIITA targeting sequence
auggcgacccaguuacauaa

SEQ ID NO: 47411 - RNA, 20 nt, Artificial Sequence
  CIITA targeting sequence
ccauggaguuuuucccuucu

SEQ ID NO: 47412 - RNA, 20 nt, Artificial Sequence
  CIITA targeting sequence
agacucucagggcaucucau

SEQ ID NO: 47413 - RNA, 20 nt, Artificial Sequence
  CIITA targeting sequence
ggacugcuuguaauaaaaau

SEQ ID NO: 47414 - RNA, 20 nt, Artificial Sequence
  CIITA targeting sequence
cagggcaucucauuagacua

SEQ ID NO: 47415 - RNA, 20 nt, Artificial Sequence
  CIITA targeting sequence
gggcaucucauuagacuauu

SEQ ID NO: 47416 - RNA, 20 nt, Artificial Sequence
  CIITA targeting sequence
cauuagacuauuaaguaguc

SEQ ID NO: 47417 - RNA, 20 nt, Artificial Sequence
  CIITA targeting sequence
uuagacuauuaaguagucca

SEQ ID NO: 47418 - RNA, 20 nt, Artificial Sequence
  CIITA targeting sequence
aaugagaugcccugagaguc

SEQ ID NO: 47419 - RNA, 20 nt, Artificial Sequence
  CIITA targeting sequence
agcauuuacccagaauucug

SEQ ID NO: 47420 - RNA, 20 nt, Artificial Sequence
  CIITA targeting sequence
ggguaaaugcuggacuacuu

SEQ ID NO: 47421 - RNA, 20 nt, Artificial Sequence
  CIITA targeting sequence
guuuccgcuuuugcaauggc

SEQ ID NO: 47422 - RNA, 20 nt, Artificial Sequence
  CIITA targeting sequence
gcuuuugcaauggcacaggu

SEQ ID NO: 47423 - RNA, 20 nt, Artificial Sequence
  CIITA targeting sequence
cucacagcccagaguccuau

SEQ ID NO: 47424 - RNA, 20 nt, Artificial Sequence
  CIITA targeting sequence
cagcccagaguccuauucug

SEQ ID NO: 47425 - RNA, 20 nt, Artificial Sequence
  CIITA targeting sequence
gggcugugagugauggucag

SEQ ID NO: 47426 - RNA, 20 nt, Artificial Sequence
  CIITA targeting sequence
uauucuggggcuauuugcuc

SEQ ID NO: 47427 - RNA, 20 nt, Artificial Sequence
  CIITA targeting sequence
ggggcuauuugcucagagcu

SEQ ID NO: 47428 - RNA, 20 nt, Artificial Sequence
  CIITA targeting sequence
gagcucugcacgaggccaag

SEQ ID NO: 47429 - RNA, 20 nt, Artificial Sequence
  CIITA targeting sequence
gagcaaauagccccagaaua

SEQ ID NO: 47430 - RNA, 20 nt, Artificial Sequence
  CIITA targeting sequence
gcacgaggccaaguuugucu

SEQ ID NO: 47431 - RNA, 20 nt, Artificial Sequence
  CIITA targeting sequence
ugcagagcucugagcaaaua

SEQ ID NO: 47432 - RNA, 20 nt, Artificial Sequence
  CIITA targeting sequence
gaaugccgcucuguacgacg

SEQ ID NO: 47433 - RNA, 20 nt, Artificial Sequence
  CIITA targeting sequence
gacaaacuuggccucgugca

SEQ ID NO: 47434 - RNA, 20 nt, Artificial Sequence
  CIITA targeting sequence
guacgacggcgcugagcaua

SEQ ID NO: 47435 - RNA, 20 nt, Artificial Sequence
  CIITA targeting sequence
uacagagcggcauucagaca

SEQ ID NO: 47436 - RNA, 20 nt, Artificial Sequence
  CIITA targeting sequence
gcgccgucguacagagcggc

SEQ ID NO: 47437 - RNA, 20 nt, Artificial Sequence
  CIITA targeting sequence
ccuggcagcuuuuuucugcu

SEQ ID NO: 47438 - RNA, 20 nt, Artificial Sequence
  CIITA targeting sequence
uggcagcuuuuuucugcugc

SEQ ID NO: 47439 - RNA, 20 nt, Artificial Sequence
  CIITA targeting sequence
uuccaagucugccggcaucu

SEQ ID NO: 47440 - RNA, 20 nt, Artificial Sequence
  CIITA targeting sequence
aagucugccggcaucuccug

SEQ ID NO: 47441 - RNA, 20 nt, Artificial Sequence
  CIITA targeting sequence
gccggcaucuccugcuugag

SEQ ID NO: 47442 - RNA, 20 nt, Artificial Sequence
  CIITA targeting sequence
ccugcuugagauucugagag

SEQ ID NO: 47443 - RNA, 20 nt, Artificial Sequence
  CIITA targeting sequence
ugcuugagauucugagaguc

SEQ ID NO: 47444 - RNA, 20 nt, Artificial Sequence
  CIITA targeting sequence
agcaggagaugccggcagac

SEQ ID NO: 47445 - RNA, 20 nt, Artificial Sequence
  CIITA targeting sequence
caagcaggagaugccggcag

SEQ ID NO: 47446 - RNA, 20 nt, Artificial Sequence
  CIITA targeting sequence
gagaguccaacaggacccaa

SEQ ID NO: 47447 - RNA, 20 nt, Artificial Sequence
  CIITA targeting sequence
gaaucucaagcaggagaugc

SEQ ID NO: 47448 - RNA, 20 nt, Artificial Sequence
  CIITA targeting sequence
cagaaucucaagcaggagau

SEQ ID NO: 47449 - RNA, 20 nt, Artificial Sequence
  CIITA targeting sequence
aacaggacccaagcaagcca

SEQ ID NO: 47450 - RNA, 20 nt, Artificial Sequence
  CIITA targeting sequence
uguuggacucucagaaucuc

SEQ ID NO: 47451 - RNA, 20 nt, Artificial Sequence
  CIITA targeting sequence
cagccccaggaaucauaugg

SEQ ID NO: 47452 - RNA, 20 nt, Artificial Sequence
  CIITA targeting sequence
gccccaggaaucauauggaa

SEQ ID NO: 47453 - RNA, 20 nt, Artificial Sequence
  CIITA targeting sequence
uggggcugagaacuggcuug

SEQ ID NO: 47454 - RNA, 20 nt, Artificial Sequence
  CIITA targeting sequence
uauggaaagcauccucagga

SEQ ID NO: 47455 - RNA, 20 nt, Artificial Sequence
  CIITA targeting sequence
auaugauuccuggggcugag

SEQ ID NO: 47456 - RNA, 20 nt, Artificial Sequence
  CIITA targeting sequence
ucaggacccuucagcuguug

SEQ ID NO: 47457 - RNA, 20 nt, Artificial Sequence
  CIITA targeting sequence
ggacccuucagcuguuggag

SEQ ID NO: 47458 - RNA, 20 nt, Artificial Sequence
  CIITA targeting sequence
ugaggaugcuuuccauauga

SEQ ID NO: 47459 - RNA, 20 nt, Artificial Sequence
  CIITA targeting sequence
gcuguuggagcauugcccgg

SEQ ID NO: 47460 - RNA, 20 nt, Artificial Sequence
  CIITA targeting sequence
uuuagcuuaaugaaaaugug

SEQ ID NO: 47461 - RNA, 20 nt, Artificial Sequence
  CIITA targeting sequence
uuaagcuaaaugaaaaugca

SEQ ID NO: 47462 - RNA, 20 nt, Artificial Sequence
  CIITA targeting sequence
cauuuucauuaagcuaaaug

SEQ ID NO: 47463 - RNA, 20 nt, Artificial Sequence
  CIITA targeting sequence
cacauuuaggucacauuuuc

SEQ ID NO: 47464 - RNA, 20 nt, Artificial Sequence
  CIITA targeting sequence
gguauaaauccuguguccug

SEQ ID NO: 47465 - RNA, 20 nt, Artificial Sequence
  CIITA targeting sequence
uguguccugaaagccccuac

SEQ ID NO: 47466 - RNA, 20 nt, Artificial Sequence
  CIITA targeting sequence
ugaaagccccuacuucaaua

SEQ ID NO: 47467 - RNA, 20 nt, Artificial Sequence
  CIITA targeting sequence
ggacacaggauuuauaccug

SEQ ID NO: 47468 - RNA, 20 nt, Artificial Sequence
  CIITA targeting sequence
gucaugacaacugaaugcau

SEQ ID NO: 47469 - RNA, 20 nt, Artificial Sequence
  CIITA targeting sequence
guagcaccccagccucgguc

SEQ ID NO: 47470 - RNA, 20 nt, Artificial Sequence
  CIITA targeting sequence
aguggguggaggucagggau

SEQ ID NO: 47471 - RNA, 20 nt, Artificial Sequence
  CIITA targeting sequence
acccacuagaugucaguagc

SEQ ID NO: 47472 - RNA, 20 nt, Artificial Sequence
  CIITA targeting sequence
gggaugcugcucaccagccu

SEQ ID NO: 47473 - RNA, 20 nt, Artificial Sequence
  CIITA targeting sequence
cugaccuccacccacuagau

SEQ ID NO: 47474 - RNA, 20 nt, Artificial Sequence
  CIITA targeting sequence
ccagccugcagugucuggga

SEQ ID NO: 47475 - RNA, 20 nt, Artificial Sequence
  CIITA targeting sequence
gggacagccucccuccauac

SEQ ID NO: 47476 - RNA, 20 nt, Artificial Sequence
  CIITA targeting sequence
cagacacugcaggcugguga

SEQ ID NO: 47477 - RNA, 20 nt, Artificial Sequence
  CIITA targeting sequence
uggcccaccuggguuugccu

SEQ ID NO: 47478 - RNA, 20 nt, Artificial Sequence
  CIITA targeting sequence
gucucgugugauuuucagcc

SEQ ID NO: 47479 - RNA, 20 nt, Artificial Sequence
  CIITA targeting sequence
cgugugauuuucagccccgu

SEQ ID NO: 47480 - RNA, 20 nt, Artificial Sequence
  CIITA targeting sequence
ugugauuuucagccccguag

SEQ ID NO: 47481 - RNA, 20 nt, Artificial Sequence
  CIITA targeting sequence
cacgagacagaggcaaaccc

SEQ ID NO: 47482 - RNA, 20 nt, Artificial Sequence
  CIITA targeting sequence
gccccguaguucacauaccu

SEQ ID NO: 47483 - RNA, 20 nt, Artificial Sequence
  CIITA targeting sequence
cauaccuccugacgaugcug

SEQ ID NO: 47484 - RNA, 20 nt, Artificial Sequence
  CIITA targeting sequence
ugacgaugcuguggaauccc

SEQ ID NO: 47485 - RNA, 20 nt, Artificial Sequence
  CIITA targeting sequence
ggagguaugugaacuacggg

SEQ ID NO: 47486 - RNA, 20 nt, Artificial Sequence
  CIITA targeting sequence
ucaggagguaugugaacuac

SEQ ID NO: 47487 - RNA, 20 nt, Artificial Sequence
  CIITA targeting sequence
cgugauggaaucucugugua

SEQ ID NO: 47488 - RNA, 20 nt, Artificial Sequence
  CIITA targeting sequence
cgggagggagcucugacccu

SEQ ID NO: 47489 - RNA, 20 nt, Artificial Sequence
  CIITA targeting sequence
aucacgggagggagcucuga

SEQ ID NO: 47490 - RNA, 20 nt, Artificial Sequence
  CIITA targeting sequence
cuguguagccaacccucugc

SEQ ID NO: 47491 - RNA, 20 nt, Artificial Sequence
  CIITA targeting sequence
guguagccaacccucugcca

SEQ ID NO: 47492 - RNA, 20 nt, Artificial Sequence
  CIITA targeting sequence
gccaaguccuugauuggaac

SEQ ID NO: 47493 - RNA, 20 nt, Artificial Sequence
  CIITA targeting sequence
uugauuggaacaaaacucuc

SEQ ID NO: 47494 - RNA, 20 nt, Artificial Sequence
  CIITA targeting sequence
aggacuuggcagaggguugg

SEQ ID NO: 47495 - RNA, 20 nt, Artificial Sequence
  CIITA targeting sequence
aaucaaggacuuggcagagg

SEQ ID NO: 47496 - RNA, 20 nt, Artificial Sequence
  CIITA targeting sequence
ccggccccuucuucuuguau

SEQ ID NO: 47497 - RNA, 20 nt, Artificial Sequence
  CIITA targeting sequence
ggccccuucuucuuguauca

SEQ ID NO: 47498 - RNA, 20 nt, Artificial Sequence
  CIITA targeting sequence
ucuuguaucacuaaaguauu

SEQ ID NO: 47499 - RNA, 20 nt, Artificial Sequence
  CIITA targeting sequence
uguaucacuaaaguauuggg

SEQ ID NO: 47500 - RNA, 20 nt, Artificial Sequence
  CIITA targeting sequence
caauacuuuagugauacaag

SEQ ID NO: 47501 - RNA, 20 nt, Artificial Sequence
  CIITA targeting sequence
agucuucucauaaccaaauu

SEQ ID NO: 47502 - RNA, 20 nt, Artificial Sequence
  CIITA targeting sequence
ucucauaaccaaauuugaca

SEQ ID NO: 47503 - RNA, 20 nt, Artificial Sequence
  CIITA targeting sequence
cauaaccaaauuugacacua

SEQ ID NO: 47504 - RNA, 20 nt, Artificial Sequence
  CIITA targeting sequence
uaaccaaauuugacacuaaa

SEQ ID NO: 47505 - RNA, 20 nt, Artificial Sequence
  CIITA targeting sequence
aauuugguuaugagaagacu

SEQ ID NO: 47506 - RNA, 20 nt, Artificial Sequence
  CIITA targeting sequence
augggcauuuuagugucaaa

SEQ ID NO: 47507 - RNA, 20 nt, Artificial Sequence
  CIITA targeting sequence
uuuccaugggcauuuuagug

SEQ ID NO: 47508 - RNA, 20 nt, Artificial Sequence
  CIITA targeting sequence
uuccuuuccaugggcauuuu

SEQ ID NO: 47509 - RNA, 20 nt, Artificial Sequence
  CIITA targeting sequence
uucccgcauugcuccacuuc

SEQ ID NO: 47510 - RNA, 20 nt, Artificial Sequence
  CIITA targeting sequence
cgcauugcuccacuucagcc

SEQ ID NO: 47511 - RNA, 20 nt, Artificial Sequence
  CIITA targeting sequence
acuucagccggauuuggcuu

SEQ ID NO: 47512 - RNA, 20 nt, Artificial Sequence
  CIITA targeting sequence
gccggauuuggcuucaccca

SEQ ID NO: 47513 - RNA, 20 nt, Artificial Sequence
  CIITA targeting sequence
ggcugaaguggagcaaugcg

SEQ ID NO: 47514 - RNA, 20 nt, Artificial Sequence
  CIITA targeting sequence
cccagccaugagggacaguc

SEQ ID NO: 47515 - RNA, 20 nt, Artificial Sequence
  CIITA targeting sequence
uggcugggugaagccaaauc

SEQ ID NO: 47516 - RNA, 20 nt, Artificial Sequence
  CIITA targeting sequence
cucauggcugggugaagcca

SEQ ID NO: 47517 - RNA, 20 nt, Artificial Sequence
  CIITA targeting sequence
cgcauuaaugcacuuccuuc

SEQ ID NO: 47518 - RNA, 20 nt, Artificial Sequence
  CIITA targeting sequence
cauuaaugcacuuccuuccg

SEQ ID NO: 47519 - RNA, 20 nt, Artificial Sequence
  CIITA targeting sequence
uuccgaggaagagcagccag

SEQ ID NO: 47520 - RNA, 20 nt, Artificial Sequence
  CIITA targeting sequence
gaggaagagcagccagccaa

SEQ ID NO: 47521 - RNA, 20 nt, Artificial Sequence
  CIITA targeting sequence
gaaggaagugcauuaaugcg

SEQ ID NO: 47522 - RNA, 20 nt, Artificial Sequence
  CIITA targeting sequence
ucggaaggaagugcauuaau

SEQ ID NO: 47523 - RNA, 20 nt, Artificial Sequence
  CIITA targeting sequence
uccucggaaggaagugcauu

SEQ ID NO: 47524 - RNA, 20 nt, Artificial Sequence
  CIITA targeting sequence
gaaggagagacugaccuuac

SEQ ID NO: 47525 - RNA, 20 nt, Artificial Sequence
  CIITA targeting sequence
gacuguugccuauuuggcug

SEQ ID NO: 47526 - RNA, 20 nt, Artificial Sequence
  CIITA targeting sequence
uucagacuguugccuauuug

SEQ ID NO: 47527 - RNA, 20 nt, Artificial Sequence
  CIITA targeting sequence
ccuucagacuguugccuauu

SEQ ID NO: 47528 - RNA, 20 nt, Artificial Sequence
  CIITA targeting sequence
cuccuucagacuguugccua

SEQ ID NO: 47529 - RNA, 20 nt, Artificial Sequence
  CIITA targeting sequence
gucucuccuucagacuguug

SEQ ID NO: 47530 - RNA, 20 nt, Artificial Sequence
  CIITA targeting sequence
ugcaaaucccguuucuuuuu

SEQ ID NO: 47531 - RNA, 20 nt, Artificial Sequence
  CIITA targeting sequence
cguuucuuuuuuuuccgcca

SEQ ID NO: 47532 - RNA, 20 nt, Artificial Sequence
  CIITA targeting sequence
uuuuuuuccgccaggucuuc

SEQ ID NO: 47533 - RNA, 20 nt, Artificial Sequence
  CIITA targeting sequence
gccaggucuucuuaauuaua

SEQ ID NO: 47534 - RNA, 20 nt, Artificial Sequence
  CIITA targeting sequence
ucuuaauuauacaucaugca

SEQ ID NO: 47535 - RNA, 20 nt, Artificial Sequence
  CIITA targeting sequence
uaauuauacaucaugcaccg

SEQ ID NO: 47536 - RNA, 20 nt, Artificial Sequence
  CIITA targeting sequence
ugcaccgcuggugaacucgu

SEQ ID NO: 47537 - RNA, 20 nt, Artificial Sequence
  CIITA targeting sequence
ccagcggugcaugauguaua

SEQ ID NO: 47538 - RNA, 20 nt, Artificial Sequence
  CIITA targeting sequence
uuagcugaagucauucugaa

SEQ ID NO: 47539 - RNA, 20 nt, Artificial Sequence
  CIITA targeting sequence
gcuaacgaguucaccagcgg

SEQ ID NO: 47540 - RNA, 20 nt, Artificial Sequence
  CIITA targeting sequence
uucugaauggugaucugucu

SEQ ID NO: 47541 - RNA, 20 nt, Artificial Sequence
  CIITA targeting sequence
gaauggugaucugucugaga

SEQ ID NO: 47542 - RNA, 20 nt, Artificial Sequence
  CIITA targeting sequence
gaaugacuucagcuaacgag

SEQ ID NO: 47543 - RNA, 20 nt, Artificial Sequence
  CIITA targeting sequence
ccauucagaaugacuucagc

SEQ ID NO: 47544 - RNA, 20 nt, Artificial Sequence
  CIITA targeting sequence
gucugagauguacgcuaaga

SEQ ID NO: 47545 - RNA, 20 nt, Artificial Sequence
  CIITA targeting sequence
gagauguacgcuaagacuga

SEQ ID NO: 47546 - RNA, 20 nt, Artificial Sequence
  CIITA targeting sequence
gacagaucaccauucagaau

SEQ ID NO: 47547 - RNA, 20 nt, Artificial Sequence
  CIITA targeting sequence
cagacagaucaccauucaga

SEQ ID NO: 47548 - RNA, 20 nt, Artificial Sequence
  CIITA targeting sequence
uagcguacaucucagacaga

SEQ ID NO: 47549 - RNA, 20 nt, Artificial Sequence
  CIITA targeting sequence
gucuuagcguacaucucaga

SEQ ID NO: 47550 - RNA, 20 nt, Artificial Sequence
  CIITA targeting sequence
uguucagucuuagcguacau

SEQ ID NO: 47551 - RNA, 20 nt, Artificial Sequence
  CIITA targeting sequence
gagaaguucuguaagucauu

SEQ ID NO: 47552 - RNA, 20 nt, Artificial Sequence
  CIITA targeting sequence
gaauauccuguucagucuua

SEQ ID NO: 47553 - RNA, 20 nt, Artificial Sequence
  CIITA targeting sequence
cugaauauccuguucagucu

SEQ ID NO: 47554 - RNA, 20 nt, Artificial Sequence
  CIITA targeting sequence
guaagucauuagcuucggga

SEQ ID NO: 47555 - RNA, 20 nt, Artificial Sequence
  CIITA targeting sequence
uuagcuucgggacugaccuu

SEQ ID NO: 47556 - RNA, 20 nt, Artificial Sequence
  CIITA targeting sequence
ggacugaccuuaacaggaaa

SEQ ID NO: 47557 - RNA, 20 nt, Artificial Sequence
  CIITA targeting sequence
cgaagcuaaugacuuacaga

SEQ ID NO: 47558 - RNA, 20 nt, Artificial Sequence
  CIITA targeting sequence
gucccgaagcuaaugacuua

SEQ ID NO: 47559 - RNA, 20 nt, Artificial Sequence
  CIITA targeting sequence
uguuaaggucagucccgaag

SEQ ID NO: 47560 - RNA, 20 nt, Artificial Sequence
  CIITA targeting sequence
uuuugcuaaucuguguguuu

SEQ ID NO: 47561 - RNA, 20 nt, Artificial Sequence
  CIITA targeting sequence
guguguuucucuaaaaucag

SEQ ID NO: 47562 - RNA, 20 nt, Artificial Sequence
  CIITA targeting sequence
cuaaaaucagaaacuaacau

SEQ ID NO: 47563 - RNA, 20 nt, Artificial Sequence
  CIITA targeting sequence
aaaaucagaaacuaacauuc

SEQ ID NO: 47564 - RNA, 20 nt, Artificial Sequence
  CIITA targeting sequence
gaaacuaacauucugaauau

SEQ ID NO: 47565 - RNA, 20 nt, Artificial Sequence
  CIITA targeting sequence
gauuuuagagaaacacacag

SEQ ID NO: 47566 - RNA, 20 nt, Artificial Sequence
  CIITA targeting sequence
gaauauauagcagugaugau

SEQ ID NO: 47567 - RNA, 20 nt, Artificial Sequence
  CIITA targeting sequence
gaauguuaguuucugauuuu

SEQ ID NO: 47568 - RNA, 20 nt, Artificial Sequence
  CIITA targeting sequence
cugcuauauauucagaaugu

SEQ ID NO: 47569 - RNA, 20 nt, Artificial Sequence
  CIITA targeting sequence
ucacugcuauauauucagaa

SEQ ID NO: 47570 - RNA, 20 nt, Artificial Sequence
  CIITA targeting sequence
gugagacacuguuaucggga

SEQ ID NO: 47571 - RNA, 20 nt, Artificial Sequence
  CIITA targeting sequence
cagauaugcaaccuaaggcc

SEQ ID NO: 47572 - RNA, 20 nt, Artificial Sequence
  CIITA targeting sequence
cacagauaugcaaccuaagg

SEQ ID NO: 47573 - RNA, 20 nt, Artificial Sequence
  CIITA targeting sequence
ggacacagugagaaaaugcc

SEQ ID NO: 47574 - RNA, 20 nt, Artificial Sequence
  CIITA targeting sequence
cgauaacagugucucacaga

SEQ ID NO: 47575 - RNA, 20 nt, Artificial Sequence
  CIITA targeting sequence
cugugucccgauaacagugu

SEQ ID NO: 47576 - RNA, 20 nt, Artificial Sequence
  CIITA targeting sequence
cacugugucccgauaacagu

SEQ ID NO: 47577 - RNA, 20 nt, Artificial Sequence
  CIITA targeting sequence
gaggaacuaaugucuacaga

SEQ ID NO: 47578 - RNA, 20 nt, Artificial Sequence
  CIITA targeting sequence
gauaaggcauuuucucacug

SEQ ID NO: 47579 - RNA, 20 nt, Artificial Sequence
  CIITA targeting sequence
ucugauaaggcauuuucuca

SEQ ID NO: 47580 - RNA, 20 nt, Artificial Sequence
  CIITA targeting sequence
acagaaguugggcgaugaac

SEQ ID NO: 47581 - RNA, 20 nt, Artificial Sequence
  CIITA targeting sequence
guagacauuaguuccucuga

SEQ ID NO: 47582 - RNA, 20 nt, Artificial Sequence
  CIITA targeting sequence
aauuugccacaccccucgcc

SEQ ID NO: 47583 - RNA, 20 nt, Artificial Sequence
  CIITA targeting sequence
ccaauuugccacaccccucg

SEQ ID NO: 47584 - RNA, 20 nt, Artificial Sequence
  CIITA targeting sequence
ccaagguggcauacacucuc

SEQ ID NO: 47585 - RNA, 20 nt, Artificial Sequence
  CIITA targeting sequence
uguucuaccccaggcugcug

SEQ ID NO: 47586 - RNA, 20 nt, Artificial Sequence
  CIITA targeting sequence
accccaggcugcugcuguuc

SEQ ID NO: 47587 - RNA, 20 nt, Artificial Sequence
  CIITA targeting sequence
gcaggaauauggauguagga

SEQ ID NO: 47588 - RNA, 20 nt, Artificial Sequence
  CIITA targeting sequence
ccugucacugaaucagcugc

SEQ ID NO: 47589 - RNA, 20 nt, Artificial Sequence
  CIITA targeting sequence
caccugucacugaaucagcu

SEQ ID NO: 47590 - RNA, 20 nt, Artificial Sequence
  CIITA targeting sequence
cugccauaaggagcuuagag

SEQ ID NO: 47591 - RNA, 20 nt, Artificial Sequence
  CIITA targeting sequence
uuauggcagggaucucaccu

SEQ ID NO: 47592 - RNA, 20 nt, Artificial Sequence
  CIITA targeting sequence
aagcuccuuauggcagggau

SEQ ID NO: 47593 - RNA, 20 nt, Artificial Sequence
  CIITA targeting sequence
cuuacccacucuaagcuccu

SEQ ID NO: 47594 - RNA, 20 nt, Artificial Sequence
  CIITA targeting sequence
cacuuacccacucuaagcuc

SEQ ID NO: 47595 - RNA, 20 nt, Artificial Sequence
  CIITA targeting sequence
ucucacuuacccacucuaag

SEQ ID NO: 47596 - RNA, 20 nt, Artificial Sequence
  CIITA targeting sequence
uaaagguuuccucucugcag

SEQ ID NO: 47597 - RNA, 20 nt, Artificial Sequence
  CIITA targeting sequence
ucucugcagccaggugcuca

SEQ ID NO: 47598 - RNA, 20 nt, Artificial Sequence
  CIITA targeting sequence
cugcagccaggugcucaggc

SEQ ID NO: 47599 - RNA, 20 nt, Artificial Sequence
  CIITA targeting sequence
gcagccaggugcucaggcag

SEQ ID NO: 47600 - RNA, 20 nt, Artificial Sequence
  CIITA targeting sequence
ggcaguggccaggcugguaa

SEQ ID NO: 47601 - RNA, 20 nt, Artificial Sequence
  CIITA targeting sequence
cccugggguaguagauuugc

SEQ ID NO: 47602 - RNA, 20 nt, Artificial Sequence
  CIITA targeting sequence
uuuuguuauucaggggagca

SEQ ID NO: 47603 - RNA, 20 nt, Artificial Sequence
  CIITA targeting sequence
ggggagcauuagcgccucug

SEQ ID NO: 47604 - RNA, 20 nt, Artificial Sequence
  CIITA targeting sequence
ccugaauaacaaaaugaccu

SEQ ID NO: 47605 - RNA, 20 nt, Artificial Sequence
  CIITA targeting sequence
gaaaagcuucccagaaacuc

SEQ ID NO: 47606 - RNA, 20 nt, Artificial Sequence
  CIITA targeting sequence
gaggcgcuaaugcuccccug

SEQ ID NO: 47607 - RNA, 20 nt, Artificial Sequence
  CIITA targeting sequence
cagaaacucuguccuuguua

SEQ ID NO: 47608 - RNA, 20 nt, Artificial Sequence
  CIITA targeting sequence
gggaagcuuuucagaggcgc

SEQ ID NO: 47609 - RNA, 20 nt, Artificial Sequence
  CIITA targeting sequence
guccuuguuagugguggugg

SEQ ID NO: 47610 - RNA, 20 nt, Artificial Sequence
  CIITA targeting sequence
uuguuaguggugguggcauu

SEQ ID NO: 47611 - RNA, 20 nt, Artificial Sequence
  CIITA targeting sequence
cuaaugccaccaccacuaac

SEQ ID NO: 47612 - RNA, 20 nt, Artificial Sequence
  CIITA targeting sequence
auucacuaaugccaccacca

SEQ ID NO: 47613 - RNA, 20 nt, Artificial Sequence
  CIITA targeting sequence
uggccccugucuggccuauc

SEQ ID NO: 47614 - RNA, 20 nt, Artificial Sequence
  CIITA targeting sequence
ggccuaucccuuucuugauu

SEQ ID NO: 47615 - RNA, 20 nt, Artificial Sequence
  CIITA targeting sequence
cuuucuugauucauucagca

SEQ ID NO: 47616 - RNA, 20 nt, Artificial Sequence
  CIITA targeting sequence
ugauucauucagcaguguug

SEQ ID NO: 47617 - RNA, 20 nt, Artificial Sequence
  CIITA targeting sequence
agaaagggauaggccagaca

SEQ ID NO: 47618 - RNA, 20 nt, Artificial Sequence
  CIITA targeting sequence
uaaagagucugugccguauu

SEQ ID NO: 47619 - RNA, 20 nt, Artificial Sequence
  CIITA targeting sequence
uuaugacauuguguaucccc

SEQ ID NO: 47620 - RNA, 20 nt, Artificial Sequence
  CIITA targeting sequence
gugccguauucgagcuuuac

SEQ ID NO: 47621 - RNA, 20 nt, Artificial Sequence
  CIITA targeting sequence
agcuuuacaguacaguagag

SEQ ID NO: 47622 - RNA, 20 nt, Artificial Sequence
  CIITA targeting sequence
aauacggcacagacucuuua

SEQ ID NO: 47623 - RNA, 20 nt, Artificial Sequence
  CIITA targeting sequence
acuguacuguaaagcucgaa

SEQ ID NO: 47624 - RNA, 20 nt, Artificial Sequence
  CIITA targeting sequence
cuacuguacuguaaagcucg

SEQ ID NO: 47625 - RNA, 20 nt, Artificial Sequence
  CIITA targeting sequence
accucucuacuguacuguaa

SEQ ID NO: 47626 - RNA, 20 nt, Artificial Sequence
  CIITA targeting sequence
auguccaccucucuacugua

SEQ ID NO: 47627 - RNA, 20 nt, Artificial Sequence
  CIITA targeting sequence
gauaugcaaauaacucacug

SEQ ID NO: 47628 - RNA, 20 nt, Artificial Sequence
  CIITA targeting sequence
ggacuuuucuuccuaaauuu

SEQ ID NO: 47629 - RNA, 20 nt, Artificial Sequence
  CIITA targeting sequence
aaaaaucuggacuuuucuuc

SEQ ID NO: 47630 - RNA, 20 nt, Artificial Sequence
  CIITA targeting sequence
ucuccaacagucagaagauc

SEQ ID NO: 47631 - RNA, 20 nt, Artificial Sequence
  CIITA targeting sequence
ccaacagucagaagaucugg

SEQ ID NO: 47632 - RNA, 20 nt, Artificial Sequence
  CIITA targeting sequence
aacagucagaagaucugguc

SEQ ID NO: 47633 - RNA, 20 nt, Artificial Sequence
  CIITA targeting sequence
gaagaucugguccccaucaa

SEQ ID NO: 47634 - RNA, 20 nt, Artificial Sequence
  CIITA targeting sequence
gacuguuggagaagauucca

SEQ ID NO: 47635 - RNA, 20 nt, Artificial Sequence
  CIITA targeting sequence
ucugacuguuggagaagauu

SEQ ID NO: 47636 - RNA, 20 nt, Artificial Sequence
  CIITA targeting sequence
gguccccaucaaugcacguu

SEQ ID NO: 47637 - RNA, 20 nt, Artificial Sequence
  CIITA targeting sequence
ccaucaaugcacguuucuac

SEQ ID NO: 47638 - RNA, 20 nt, Artificial Sequence
  CIITA targeting sequence
augcacguuucuacgggaag

SEQ ID NO: 47639 - RNA, 20 nt, Artificial Sequence
  CIITA targeting sequence
acgggaagcuucgcagagcc

SEQ ID NO: 47640 - RNA, 20 nt, Artificial Sequence
  CIITA targeting sequence
cguagaaacgugcauugaug

SEQ ID NO: 47641 - RNA, 20 nt, Artificial Sequence
  CIITA targeting sequence
cagagccugcccccaucaga

SEQ ID NO: 47642 - RNA, 20 nt, Artificial Sequence
  CIITA targeting sequence
cucgggacuuuuuuuuuuuu

SEQ ID NO: 47643 - RNA, 20 nt, Artificial Sequence
  CIITA targeting sequence
ggacuuuuuuuuuuuuuuag

SEQ ID NO: 47644 - RNA, 20 nt, Artificial Sequence
  CIITA targeting sequence
cgagggacccaguacaucuc

SEQ ID NO: 47645 - RNA, 20 nt, Artificial Sequence
  CIITA targeting sequence
ugcaacuaaaaaaaaaaaaa

SEQ ID NO: 47646 - RNA, 20 nt, Artificial Sequence
  CIITA targeting sequence
aagccugaggauagcugccg

SEQ ID NO: 47647 - RNA, 20 nt, Artificial Sequence
  CIITA targeting sequence
ggcuuggaaaucaugcaacu

SEQ ID NO: 47648 - RNA, 20 nt, Artificial Sequence
  CIITA targeting sequence
ucaggcuuggaaaucaugca

SEQ ID NO: 47649 - RNA, 20 nt, Artificial Sequence
  CIITA targeting sequence
ucucagauugucuuacugua

SEQ ID NO: 47650 - RNA, 20 nt, Artificial Sequence
  CIITA targeting sequence
cagauugucuuacuguaaga

SEQ ID NO: 47651 - RNA, 20 nt, Artificial Sequence
  CIITA targeting sequence
gauugucuuacuguaagaua

SEQ ID NO: 47652 - RNA, 20 nt, Artificial Sequence
  CIITA targeting sequence
acaauaauguuaaccauaca

SEQ ID NO: 47653 - RNA, 20 nt, Artificial Sequence
  CIITA targeting sequence
uucagcagauuucuagaucu

SEQ ID NO: 47654 - RNA, 20 nt, Artificial Sequence
  CIITA targeting sequence
gcagauuucuagaucucauu

SEQ ID NO: 47655 - RNA, 20 nt, Artificial Sequence
  CIITA targeting sequence
gcugaaugaugcugugccua

SEQ ID NO: 47656 - RNA, 20 nt, Artificial Sequence
  CIITA targeting sequence
agaucucauuuaucuugcau

SEQ ID NO: 47657 - RNA, 20 nt, Artificial Sequence
  CIITA targeting sequence
ccauucuccucucugcauga

SEQ ID NO: 47658 - RNA, 20 nt, Artificial Sequence
  CIITA targeting sequence
ccucucugcaugaguuugac

SEQ ID NO: 47659 - RNA, 20 nt, Artificial Sequence
  CIITA targeting sequence
ucucugcaugaguuugacaa

SEQ ID NO: 47660 - RNA, 20 nt, Artificial Sequence
  CIITA targeting sequence
cugcaugaguuugacaauuu

SEQ ID NO: 47661 - RNA, 20 nt, Artificial Sequence
  CIITA targeting sequence
gcaugaguuugacaauuuua

SEQ ID NO: 47662 - RNA, 20 nt, Artificial Sequence
  CIITA targeting sequence
ugcagagaggagaaugguga

SEQ ID NO: 47663 - RNA, 20 nt, Artificial Sequence
  CIITA targeting sequence
aacucaugcagagaggagaa

SEQ ID NO: 47664 - RNA, 20 nt, Artificial Sequence
  CIITA targeting sequence
aaaauugucaaacucaugca

SEQ ID NO: 47665 - RNA, 20 nt, Artificial Sequence
  CIITA targeting sequence
uauaaguagaaucgugcagc

SEQ ID NO: 47666 - RNA, 20 nt, Artificial Sequence
  CIITA targeting sequence
acuuauacgagguaucuaaa

SEQ ID NO: 47667 - RNA, 20 nt, Artificial Sequence
  CIITA targeting sequence
ugcagcauuugucuuuguca

SEQ ID NO: 47668 - RNA, 20 nt, Artificial Sequence
  CIITA targeting sequence
auuaaaaaaaaaacugcaua

SEQ ID NO: 47669 - RNA, 20 nt, Artificial Sequence
  CIITA targeting sequence
guaaaaaauuucaauuaaaa

SEQ ID NO: 47670 - RNA, 20 nt, Artificial Sequence
  CIITA targeting sequence
caguaaaaaauuucaauuaa

SEQ ID NO: 47671 - RNA, 20 nt, Artificial Sequence
  CIITA targeting sequence
auaauuaucucaguaaaaaa

SEQ ID NO: 47672 - RNA, 20 nt, Artificial Sequence
  CIITA targeting sequence
auauccugcuugugagggug

SEQ ID NO: 47673 - RNA, 20 nt, Artificial Sequence
  CIITA targeting sequence
cugucaauauccugcuugug

SEQ ID NO: 47674 - RNA, 20 nt, Artificial Sequence
  CIITA targeting sequence
uauguaucacugucaauauc

SEQ ID NO: 47675 - RNA, 20 nt, Artificial Sequence
  CIITA targeting sequence
aacauaaauccuauguauca

SEQ ID NO: 47676 - RNA, 20 nt, Artificial Sequence
  CIITA targeting sequence
caguuuaggacacuggcugu

SEQ ID NO: 47677 - RNA, 20 nt, Artificial Sequence
  CIITA targeting sequence
guuuaggacacuggcuguag

SEQ ID NO: 47678 - RNA, 20 nt, Artificial Sequence
  CIITA targeting sequence
uaaacugagagguugccagu

SEQ ID NO: 47679 - RNA, 20 nt, Artificial Sequence
  CIITA targeting sequence
cauuuucaguucaggugucc

SEQ ID NO: 47680 - RNA, 20 nt, Artificial Sequence
  CIITA targeting sequence
guagcguggagggaauugcu

SEQ ID NO: 47681 - RNA, 20 nt, Artificial Sequence
  CIITA targeting sequence
acgcuacagagucucauuuu

SEQ ID NO: 47682 - RNA, 20 nt, Artificial Sequence
  CIITA targeting sequence
cuccacgcuacagagucuca

SEQ ID NO: 47683 - RNA, 20 nt, Artificial Sequence
  CIITA targeting sequence
gcuuucugcuuccaguuacu

SEQ ID NO: 47684 - RNA, 20 nt, Artificial Sequence
  CIITA targeting sequence
gcuuccaguuacuaccuuuc

SEQ ID NO: 47685 - RNA, 20 nt, Artificial Sequence
  CIITA targeting sequence
aguuacuaccuuucucucag

SEQ ID NO: 47686 - RNA, 20 nt, Artificial Sequence
  CIITA targeting sequence
cucagugugaaguugaaguu

SEQ ID NO: 47687 - RNA, 20 nt, Artificial Sequence
  CIITA targeting sequence
cagugugaaguugaaguugg

SEQ ID NO: 47688 - RNA, 20 nt, Artificial Sequence
  CIITA targeting sequence
gugugaaguugaaguugguu

SEQ ID NO: 47689 - RNA, 20 nt, Artificial Sequence
  CIITA targeting sequence
acuucacacugagagaaagg

SEQ ID NO: 47690 - RNA, 20 nt, Artificial Sequence
  CIITA targeting sequence
gaugacuaucguucagguuu

SEQ ID NO: 47691 - RNA, 20 nt, Artificial Sequence
  CIITA targeting sequence
gauuacaaccaacuucaacu

SEQ ID NO: 47692 - RNA, 20 nt, Artificial Sequence
  CIITA targeting sequence
ucagauuacaaccaacuuca

SEQ ID NO: 47693 - RNA, 20 nt, Artificial Sequence
  CIITA targeting sequence
uucagguuugggaagagcac

SEQ ID NO: 47694 - RNA, 20 nt, Artificial Sequence
  CIITA targeting sequence
gguuugggaagagcacaggc

SEQ ID NO: 47695 - RNA, 20 nt, Artificial Sequence
  CIITA targeting sequence
caaaccugaacgauagucau

SEQ ID NO: 47696 - RNA, 20 nt, Artificial Sequence
  CIITA targeting sequence
ucccaaaccugaacgauagu

SEQ ID NO: 47697 - RNA, 20 nt, Artificial Sequence
  CIITA targeting sequence
gccugugcucuucccaaacc

SEQ ID NO: 47698 - RNA, 20 nt, Artificial Sequence
  CIITA targeting sequence
uucugugacuuguuugauaa

SEQ ID NO: 47699 - RNA, 20 nt, Artificial Sequence
  CIITA targeting sequence
gugacuuguuugauaauagu

SEQ ID NO: 47700 - RNA, 20 nt, Artificial Sequence
  CIITA targeting sequence
cagaaggaauucagccugug

SEQ ID NO: 47701 - RNA, 20 nt, Artificial Sequence
  CIITA targeting sequence
aacaagucacagaaggaauu

SEQ ID NO: 47702 - RNA, 20 nt, Artificial Sequence
  CIITA targeting sequence
ugguacgauuuaccuuccuu

SEQ ID NO: 47703 - RNA, 20 nt, Artificial Sequence
  CIITA targeting sequence
uaccaggacuauuaucaaac

SEQ ID NO: 47704 - RNA, 20 nt, Artificial Sequence
  CIITA targeting sequence
uucccuaugagcgagaacag

SEQ ID NO: 47705 - RNA, 20 nt, Artificial Sequence
  CIITA targeting sequence
cuaugagcgagaacagacuc

SEQ ID NO: 47706 - RNA, 20 nt, Artificial Sequence
  CIITA targeting sequence
uagggaaggaagguaaaucg

SEQ ID NO: 47707 - RNA, 20 nt, Artificial Sequence
  CIITA targeting sequence
cucauagggaaggaagguaa

SEQ ID NO: 47708 - RNA, 20 nt, Artificial Sequence
  CIITA targeting sequence
cgcucauagggaaggaaggu

SEQ ID NO: 47709 - RNA, 20 nt, Artificial Sequence
  CIITA targeting sequence
guucucgcucauagggaagg

SEQ ID NO: 47710 - RNA, 20 nt, Artificial Sequence
  CIITA targeting sequence
uauuguuuccugcccaacuc

SEQ ID NO: 47711 - RNA, 20 nt, Artificial Sequence
  CIITA targeting sequence
ugcccaacucggaugugguu

SEQ ID NO: 47712 - RNA, 20 nt, Artificial Sequence
  CIITA targeting sequence
gaugugguuugauuauacuu

SEQ ID NO: 47713 - RNA, 20 nt, Artificial Sequence
  CIITA targeting sequence
gaguugggcaggaaacaaua

SEQ ID NO: 47714 - RNA, 20 nt, Artificial Sequence
  CIITA targeting sequence
aaccacauccgaguugggca

SEQ ID NO: 47715 - RNA, 20 nt, Artificial Sequence
  CIITA targeting sequence
uggucuuuuuuaaccuacuu

SEQ ID NO: 47716 - RNA, 20 nt, Artificial Sequence
  CIITA targeting sequence
uuuuuaaccuacuuucuccu

SEQ ID NO: 47717 - RNA, 20 nt, Artificial Sequence
  CIITA targeting sequence
ccuucccguaauuuguagau

SEQ ID NO: 47718 - RNA, 20 nt, Artificial Sequence
  CIITA targeting sequence
uucccguaauuuguagauaa

SEQ ID NO: 47719 - RNA, 20 nt, Artificial Sequence
  CIITA targeting sequence
cguaauuuguagauaaguua

SEQ ID NO: 47720 - RNA, 20 nt, Artificial Sequence
  CIITA targeting sequence
acaaauuacgggaaggagaa

SEQ ID NO: 47721 - RNA, 20 nt, Artificial Sequence
  CIITA targeting sequence
uuuuuaccagcagaccuuuc

SEQ ID NO: 47722 - RNA, 20 nt, Artificial Sequence
  CIITA targeting sequence
gcugguaaaaaugaggcaau

SEQ ID NO: 47723 - RNA, 20 nt, Artificial Sequence
  CIITA targeting sequence
caaaaccaaaccaaaauuga

SEQ ID NO: 47724 - RNA, 20 nt, Artificial Sequence
  CIITA targeting sequence
auuuugguuugguuuuguga

SEQ ID NO: 47725 - RNA, 20 nt, Artificial Sequence
  CIITA targeting sequence
ucaauuuugguuugguuuug

SEQ ID NO: 47726 - RNA, 20 nt, Artificial Sequence
  CIITA targeting sequence
cuucaauuuugguuugguuu

SEQ ID NO: 47727 - RNA, 20 nt, Artificial Sequence
  CIITA targeting sequence
cucuucaauuuugguuuggu

SEQ ID NO: 47728 - RNA, 20 nt, Artificial Sequence
  CIITA targeting sequence
cucucuucaauuuugguuug

SEQ ID NO: 47729 - RNA, 20 nt, Artificial Sequence
  CIITA targeting sequence
gcuucucucucuucaauuuu

SEQ ID NO: 47730 - RNA, 20 nt, Artificial Sequence
  CIITA targeting sequence
ccucugcuucucucucuuca

SEQ ID NO: 47731 - RNA, 20 nt, Artificial Sequence
  CIITA targeting sequence
ccccucugcuucucucucuu

SEQ ID NO: 47732 - RNA, 20 nt, Artificial Sequence
  CIITA targeting sequence
caguuauuugaaaggacugu

SEQ ID NO: 47733 - RNA, 20 nt, Artificial Sequence
  CIITA targeting sequence
aauaacugugaucuccccuc

SEQ ID NO: 47734 - RNA, 20 nt, Artificial Sequence
  CIITA targeting sequence
uuucaaauaacugugaucuc

SEQ ID NO: 47735 - RNA, 20 nt, Artificial Sequence
  CIITA targeting sequence
auuuaacccuaaauuacagu

SEQ ID NO: 47736 - RNA, 20 nt, Artificial Sequence
  CIITA targeting sequence
gcaugguuagaugaaugucu

SEQ ID NO: 47737 - RNA, 20 nt, Artificial Sequence
  CIITA targeting sequence
aaccaugcugauguguuuuc

SEQ ID NO: 47738 - RNA, 20 nt, Artificial Sequence
  CIITA targeting sequence
ucuaaccaugcugauguguu

SEQ ID NO: 47739 - RNA, 20 nt, Artificial Sequence
  CIITA targeting sequence
aauugaaauucaucugugcg

SEQ ID NO: 47740 - RNA, 20 nt, Artificial Sequence
  CIITA targeting sequence
auuagacauucaucuaacca

SEQ ID NO: 47741 - RNA, 20 nt, Artificial Sequence
  CIITA targeting sequence
ucugugcguuaaaaucauau

SEQ ID NO: 47742 - RNA, 20 nt, Artificial Sequence
  CIITA targeting sequence
gugcguuaaaaucauauggu

SEQ ID NO: 47743 - RNA, 20 nt, Artificial Sequence
  CIITA targeting sequence
uaugguuccugcuaaaggcu

SEQ ID NO: 47744 - RNA, 20 nt, Artificial Sequence
  CIITA targeting sequence
ugcuaaaggcuaauucuugc

SEQ ID NO: 47745 - RNA, 20 nt, Artificial Sequence
  CIITA targeting sequence
ugcuauaauucgaaugcaga

SEQ ID NO: 47746 - RNA, 20 nt, Artificial Sequence
  CIITA targeting sequence
aaugcagagcagauaguguu

SEQ ID NO: 47747 - RNA, 20 nt, Artificial Sequence
  CIITA targeting sequence
aauuauagcaagaauuagcc

SEQ ID NO: 47748 - RNA, 20 nt, Artificial Sequence
  CIITA targeting sequence
gcauucgaauuauagcaaga

SEQ ID NO: 47749 - RNA, 20 nt, Artificial Sequence
  CIITA targeting sequence
gcucugcauucgaauuauag

SEQ ID NO: 47750 - RNA, 20 nt, Artificial Sequence
  CIITA targeting sequence
uguguggggaaaucgaguag

SEQ ID NO: 47751 - RNA, 20 nt, Artificial Sequence
  CIITA targeting sequence
ccacacaagaaacacuaucu

SEQ ID NO: 47752 - RNA, 20 nt, Artificial Sequence
  CIITA targeting sequence
aguaggacaacacuaauucu

SEQ ID NO: 47753 - RNA, 20 nt, Artificial Sequence
  CIITA targeting sequence
auuuccccacacaagaaaca

SEQ ID NO: 47754 - RNA, 20 nt, Artificial Sequence
  CIITA targeting sequence
uacucgauuuccccacacaa

SEQ ID NO: 47755 - RNA, 20 nt, Artificial Sequence
  CIITA targeting sequence
gaaacugcuaacaucucguu

SEQ ID NO: 47756 - RNA, 20 nt, Artificial Sequence
  CIITA targeting sequence
gaauuaguguuguccuacuc

SEQ ID NO: 47757 - RNA, 20 nt, Artificial Sequence
  CIITA targeting sequence
cguuguuuuugcagaaugaa

SEQ ID NO: 47758 - RNA, 20 nt, Artificial Sequence
  CIITA targeting sequence
uuguuuuugcagaaugaaca

SEQ ID NO: 47759 - RNA, 20 nt, Artificial Sequence
  CIITA targeting sequence
gcaaaaacaacgagauguua

SEQ ID NO: 47760 - RNA, 20 nt, Artificial Sequence
  CIITA targeting sequence
uucugcaaaaacaacgagau

SEQ ID NO: 47761 - RNA, 20 nt, Artificial Sequence
  CIITA targeting sequence
gcuaccacuucacccacuga

SEQ ID NO: 47762 - RNA, 20 nt, Artificial Sequence
  CIITA targeting sequence
caagggcucucgugacauuc

SEQ ID NO: 47763 - RNA, 20 nt, Artificial Sequence
  CIITA targeting sequence
cgugacauucuuguaaugac

SEQ ID NO: 47764 - RNA, 20 nt, Artificial Sequence
  CIITA targeting sequence
ugacauucuuguaaugacuc

SEQ ID NO: 47765 - RNA, 20 nt, Artificial Sequence
  CIITA targeting sequence
cgagagcccuugugacucug

SEQ ID NO: 47766 - RNA, 20 nt, Artificial Sequence
  CIITA targeting sequence
uguaaugacucucagagcag

SEQ ID NO: 47767 - RNA, 20 nt, Artificial Sequence
  CIITA targeting sequence
uuacaagaaugucacgagag

SEQ ID NO: 47768 - RNA, 20 nt, Artificial Sequence
  CIITA targeting sequence
cagagcagaagucacuuccu

SEQ ID NO: 47769 - RNA, 20 nt, Artificial Sequence
  CIITA targeting sequence
gagcagaagucacuuccuag

SEQ ID NO: 47770 - RNA, 20 nt, Artificial Sequence
  CIITA targeting sequence
gagagucauuacaagaaugu

SEQ ID NO: 47771 - RNA, 20 nt, Artificial Sequence
  CIITA targeting sequence
gcucugagagucauuacaag

SEQ ID NO: 47772 - RNA, 20 nt, Artificial Sequence
  CIITA targeting sequence
cuuccuagccugccccuuga

SEQ ID NO: 47773 - RNA, 20 nt, Artificial Sequence
  CIITA targeting sequence
uagccugccccuugaaugcc

SEQ ID NO: 47774 - RNA, 20 nt, Artificial Sequence
  CIITA targeting sequence
aggggcaggcuaggaaguga

SEQ ID NO: 47775 - RNA, 20 nt, Artificial Sequence
  CIITA targeting sequence
aaagccaccccacugaaggg

SEQ ID NO: 47776 - RNA, 20 nt, Artificial Sequence
  CIITA targeting sequence
gcucaaaagccaccccacug

SEQ ID NO: 47777 - RNA, 20 nt, Artificial Sequence
  CIITA targeting sequence
gugccuuggugucugcucaa

SEQ ID NO: 47778 - RNA, 20 nt, Artificial Sequence
  CIITA targeting sequence
cucugugccuuggugucugc

SEQ ID NO: 47779 - RNA, 20 nt, Artificial Sequence
  CIITA targeting sequence
cccucugugccuuggugucu

SEQ ID NO: 47780 - RNA, 20 nt, Artificial Sequence
  CIITA targeting sequence
cuguuauuacuaacacuucu

SEQ ID NO: 47781 - RNA, 20 nt, Artificial Sequence
  CIITA targeting sequence
ucacuguuauuacuaacacu

SEQ ID NO: 47782 - RNA, 20 nt, Artificial Sequence
  CIITA targeting sequence
ucaucacuguuauuacuaac

SEQ ID NO: 47783 - RNA, 20 nt, Artificial Sequence
  CIITA targeting sequence
aaggcgcgcacauucuucuu

SEQ ID NO: 47784 - RNA, 20 nt, Artificial Sequence
  CIITA targeting sequence
ucuuccugaaaaugcuaaua

SEQ ID NO: 47785 - RNA, 20 nt, Artificial Sequence
  CIITA targeting sequence
uccugaaaaugcuaauaggc

SEQ ID NO: 47786 - RNA, 20 nt, Artificial Sequence
  CIITA targeting sequence
ugaaaaugcuaauaggcuuc

SEQ ID NO: 47787 - RNA, 20 nt, Artificial Sequence
  CIITA targeting sequence
ggaagaagaaugugcgcgcc

SEQ ID NO: 47788 - RNA, 20 nt, Artificial Sequence
  CIITA targeting sequence
gggagaagguugauugugaa

SEQ ID NO: 47789 - RNA, 20 nt, Artificial Sequence
  CIITA targeting sequence
cagaagccuauuagcauuuu

SEQ ID NO: 47790 - RNA, 20 nt, Artificial Sequence
  CIITA targeting sequence
cccagaagccuauuagcauu

SEQ ID NO: 47791 - RNA, 20 nt, Artificial Sequence
  CIITA targeting sequence
accuucucccagaagccuau

SEQ ID NO: 47792 - RNA, 20 nt, Artificial Sequence
  CIITA targeting sequence
caaucaaccuucucccagaa

SEQ ID NO: 47793 - RNA, 20 nt, Artificial Sequence
  CIITA targeting sequence
aaggguaaagauagacuucu

SEQ ID NO: 47794 - RNA, 20 nt, Artificial Sequence
  CIITA targeting sequence
uuacccuuugauauucacaa

SEQ ID NO: 47795 - RNA, 20 nt, Artificial Sequence
  CIITA targeting sequence
aucuuuacccuuugauauuc

SEQ ID NO: 47796 - RNA, 20 nt, Artificial Sequence
  CIITA targeting sequence
auaaauuaagggccuuaauu

SEQ ID NO: 47797 - RNA, 20 nt, Artificial Sequence
  CIITA targeting sequence
auuaaggcccuuaauuuaua

SEQ ID NO: 47798 - RNA, 20 nt, Artificial Sequence
  CIITA targeting sequence
caaaaaaaaaaaaaaaaaaa

SEQ ID NO: 47799 - RNA, 20 nt, Artificial Sequence
  CIITA targeting sequence
aaaaaaaaaaaaaaaaaaaa

SEQ ID NO: 47800 - RNA, 20 nt, Artificial Sequence
  CIITA targeting sequence
uuuuuuuuuuuuuuuuuuuu

SEQ ID NO: 47801 - RNA, 20 nt, Artificial Sequence
  CIITA targeting sequence
caccgcagggccuuugcacu

SEQ ID NO: 47802 - RNA, 20 nt, Artificial Sequence
  CIITA targeting sequence
aacacacuaggcaccauccc

SEQ ID NO: 47803 - RNA, 20 nt, Artificial Sequence
  CIITA targeting sequence
uccaacacacuaggcaccau

SEQ ID NO: 47804 - RNA, 20 nt, Artificial Sequence
  CIITA targeting sequence
cucaaauaauauugugcugg

SEQ ID NO: 47805 - RNA, 20 nt, Artificial Sequence
  CIITA targeting sequence
aauaauauugugcuggguga

SEQ ID NO: 47806 - RNA, 20 nt, Artificial Sequence
  CIITA targeting sequence
cccagcacaauauuauuuga

SEQ ID NO: 47807 - RNA, 20 nt, Artificial Sequence
  CIITA targeting sequence
agugucacccagcacaauau

SEQ ID NO: 47808 - RNA, 20 nt, Artificial Sequence
  CIITA targeting sequence
gggugggucauuuucugaca

SEQ ID NO: 47809 - RNA, 20 nt, Artificial Sequence
  CIITA targeting sequence
uuuucugacaugagcagaau

SEQ ID NO: 47810 - RNA, 20 nt, Artificial Sequence
  CIITA targeting sequence
gacaugagcagaaugugcuc

SEQ ID NO: 47811 - RNA, 20 nt, Artificial Sequence
  CIITA targeting sequence
gaaaaugacccacccagaac

SEQ ID NO: 47812 - RNA, 20 nt, Artificial Sequence
  CIITA targeting sequence
gcagcugcaacacuugauaa

SEQ ID NO: 47813 - RNA, 20 nt, Artificial Sequence
  CIITA targeting sequence
aguguugcagcugcagaggc

SEQ ID NO: 47814 - RNA, 20 nt, Artificial Sequence
  CIITA targeting sequence
uggagaagaaugccguguuc

SEQ ID NO: 47815 - RNA, 20 nt, Artificial Sequence
  CIITA targeting sequence
augaauuaccaguuaucaag

SEQ ID NO: 47816 - RNA, 20 nt, Artificial Sequence
  CIITA targeting sequence
ccaugaauuaccaguuauca

SEQ ID NO: 47817 - RNA, 20 nt, Artificial Sequence
  CIITA targeting sequence
ucuccaugaauuaccaguua

SEQ ID NO: 47818 - RNA, 20 nt, Artificial Sequence
  CIITA targeting sequence
ccuuguuaauggaagcggcc

SEQ ID NO: 47819 - RNA, 20 nt, Artificial Sequence
  CIITA targeting sequence
uuguuaauggaagcggccug

SEQ ID NO: 47820 - RNA, 20 nt, Artificial Sequence
  CIITA targeting sequence
acagcuccacgcggcuccug

SEQ ID NO: 47821 - RNA, 20 nt, Artificial Sequence
  CIITA targeting sequence
acgcggcuccuggauuggcg

SEQ ID NO: 47822 - RNA, 20 nt, Artificial Sequence
  CIITA targeting sequence
uggauuggcgaguaaggcau

SEQ ID NO: 47823 - RNA, 20 nt, Artificial Sequence
  CIITA targeting sequence
aggagccgcguggagcugug

SEQ ID NO: 47824 - RNA, 20 nt, Artificial Sequence
  CIITA targeting sequence
ccaauccaggagccgcgugg

SEQ ID NO: 47825 - RNA, 20 nt, Artificial Sequence
  CIITA targeting sequence
auacaucacccugggguaca

SEQ ID NO: 47826 - RNA, 20 nt, Artificial Sequence
  CIITA targeting sequence
cccugggguacaucacccau

SEQ ID NO: 47827 - RNA, 20 nt, Artificial Sequence
  CIITA targeting sequence
gccaguggccaagccaugug

SEQ ID NO: 47828 - RNA, 20 nt, Artificial Sequence
  CIITA targeting sequence
cacccacuguaaccaacagc

SEQ ID NO: 47829 - RNA, 20 nt, Artificial Sequence
  CIITA targeting sequence
ugugacuuuuugucucugug

SEQ ID NO: 47830 - RNA, 20 nt, Artificial Sequence
  CIITA targeting sequence
caggaggucacacccacugu

SEQ ID NO: 47831 - RNA, 20 nt, Artificial Sequence
  CIITA targeting sequence
cuguguuuaucagguaaaaa

SEQ ID NO: 47832 - RNA, 20 nt, Artificial Sequence
  CIITA targeting sequence
guguuuaucagguaaaaaug

SEQ ID NO: 47833 - RNA, 20 nt, Artificial Sequence
  CIITA targeting sequence
ccugcccucucuuccauccu

SEQ ID NO: 47834 - RNA, 20 nt, Artificial Sequence
  CIITA targeting sequence
cuuccauccucgugaucuau

SEQ ID NO: 47835 - RNA, 20 nt, Artificial Sequence
  CIITA targeting sequence
uccauccucgugaucuauuu

SEQ ID NO: 47836 - RNA, 20 nt, Artificial Sequence
  CIITA targeting sequence
auccucgugaucuauuugcc

SEQ ID NO: 47837 - RNA, 20 nt, Artificial Sequence
  CIITA targeting sequence
ucgugaucuauuugccaggg

SEQ ID NO: 47838 - RNA, 20 nt, Artificial Sequence
  CIITA targeting sequence
ugaucuauuugccagggggu

SEQ ID NO: 47839 - RNA, 20 nt, Artificial Sequence
  CIITA targeting sequence
cgaggauggaagagagggca

SEQ ID NO: 47840 - RNA, 20 nt, Artificial Sequence
  CIITA targeting sequence
auuugccaggggguugaagg

SEQ ID NO: 47841 - RNA, 20 nt, Artificial Sequence
  CIITA targeting sequence
acccccuggcaaauagauca

SEQ ID NO: 47842 - RNA, 20 nt, Artificial Sequence
  CIITA targeting sequence
uugcccuucaacccccuggc

SEQ ID NO: 47843 - RNA, 20 nt, Artificial Sequence
  CIITA targeting sequence
cuggugcccccuuguaccag

SEQ ID NO: 47844 - RNA, 20 nt, Artificial Sequence
  CIITA targeting sequence
ggugcccccuuguaccaggc

SEQ ID NO: 47845 - RNA, 20 nt, Artificial Sequence
  CIITA targeting sequence
guggggcagcagggagggga

SEQ ID NO: 47846 - RNA, 20 nt, Artificial Sequence
  CIITA targeting sequence
auucaguggggcagcaggga

SEQ ID NO: 47847 - RNA, 20 nt, Artificial Sequence
  CIITA targeting sequence
gcaucuauucaguggggcag

SEQ ID NO: 47848 - RNA, 20 nt, Artificial Sequence
  CIITA targeting sequence
cagcaucuauucaguggggc

SEQ ID NO: 47849 - RNA, 20 nt, Artificial Sequence
  CIITA targeting sequence
acacguugcaucuauagggc

SEQ ID NO: 47850 - RNA, 20 nt, Artificial Sequence
  CIITA targeting sequence
auagggcauugagucaaggu

SEQ ID NO: 47851 - RNA, 20 nt, Artificial Sequence
  CIITA targeting sequence
augcccuauagaugcaacgu

SEQ ID NO: 47852 - RNA, 20 nt, Artificial Sequence
  CIITA targeting sequence
agguaucugauaucucuucu

SEQ ID NO: 47853 - RNA, 20 nt, Artificial Sequence
  CIITA targeting sequence
gauaucucuucugaggcugu

SEQ ID NO: 47854 - RNA, 20 nt, Artificial Sequence
  CIITA targeting sequence
gauaccuugacucaaugccc

SEQ ID NO: 47855 - RNA, 20 nt, Artificial Sequence
  CIITA targeting sequence
cuucugaggcugugagccug

SEQ ID NO: 47856 - RNA, 20 nt, Artificial Sequence
  CIITA targeting sequence
ucugaggcugugagccugaa

SEQ ID NO: 47857 - RNA, 20 nt, Artificial Sequence
  CIITA targeting sequence
gaggcugugagccugaagaa

SEQ ID NO: 47858 - RNA, 20 nt, Artificial Sequence
  CIITA targeting sequence
gaagagauaucagauaccuu

SEQ ID NO: 47859 - RNA, 20 nt, Artificial Sequence
  CIITA targeting sequence
cagccucagaagagauauca

SEQ ID NO: 47860 - RNA, 20 nt, Artificial Sequence
  CIITA targeting sequence
ggcucacagccucagaagag

SEQ ID NO: 47861 - RNA, 20 nt, Artificial Sequence
  CIITA targeting sequence
ucaggcucacagccucagaa

SEQ ID NO: 47862 - RNA, 20 nt, Artificial Sequence
  CIITA targeting sequence
caaagggguucuucaggcuc

SEQ ID NO: 47863 - RNA, 20 nt, Artificial Sequence
  CIITA targeting sequence
ggcacuagcccgugcugcuc

SEQ ID NO: 47864 - RNA, 20 nt, Artificial Sequence
  CIITA targeting sequence
gucaggcacuagcccgugcu

SEQ ID NO: 47865 - RNA, 20 nt, Artificial Sequence
  CIITA targeting sequence
cagucaggcacuagcccgug

SEQ ID NO: 47866 - RNA, 20 nt, Artificial Sequence
  CIITA targeting sequence
ccggccagccaguagccucu

SEQ ID NO: 47867 - RNA, 20 nt, Artificial Sequence
  CIITA targeting sequence
gggcagugguccccggccag

SEQ ID NO: 47868 - RNA, 20 nt, Artificial Sequence
  CIITA targeting sequence
ugcaaaguccagcggcugug

SEQ ID NO: 47869 - RNA, 20 nt, Artificial Sequence
  CIITA targeting sequence
agcggcugugcaucugcccc

SEQ ID NO: 47870 - RNA, 20 nt, Artificial Sequence
  CIITA targeting sequence
gccccuaccuggggagcugg

SEQ ID NO: 47871 - RNA, 20 nt, Artificial Sequence
  CIITA targeting sequence
ccagguaggggcagaugcac

SEQ ID NO: 47872 - RNA, 20 nt, Artificial Sequence
  CIITA targeting sequence
gccagcuccccagguagggg

SEQ ID NO: 47873 - RNA, 20 nt, Artificial Sequence
  CIITA targeting sequence
aaggguaccaccacugucac

SEQ ID NO: 47874 - RNA, 20 nt, Artificial Sequence
  CIITA targeting sequence
ccaagcaccagccccaggug

SEQ ID NO: 47875 - RNA, 20 nt, Artificial Sequence
  CIITA targeting sequence
ccuggggcuggugcuuggug

SEQ ID NO: 47876 - RNA, 20 nt, Artificial Sequence
  CIITA targeting sequence
gcuaaggccuaggucaccug

SEQ ID NO: 47877 - RNA, 20 nt, Artificial Sequence
  CIITA targeting sequence
ccuuuuacuucugcuaaggc

SEQ ID NO: 47878 - RNA, 20 nt, Artificial Sequence
  CIITA targeting sequence
cccaccuguucgcuuugucc

SEQ ID NO: 47879 - RNA, 20 nt, Artificial Sequence
  CIITA targeting sequence
caccuguucgcuuuguccua

SEQ ID NO: 47880 - RNA, 20 nt, Artificial Sequence
  CIITA targeting sequence
cuuuguccuaccuuguauuu

SEQ ID NO: 47881 - RNA, 20 nt, Artificial Sequence
  CIITA targeting sequence
uaccuuguauuuagggcauu

SEQ ID NO: 47882 - RNA, 20 nt, Artificial Sequence
  CIITA targeting sequence
aacuucauugaaaauccucu

SEQ ID NO: 47883 - RNA, 20 nt, Artificial Sequence
  CIITA targeting sequence
uugaaaauccucuugguaaa

SEQ ID NO: 47884 - RNA, 20 nt, Artificial Sequence
  CIITA targeting sequence
augaaguuggauugcuguaa

SEQ ID NO: 47885 - RNA, 20 nt, Artificial Sequence
  CIITA targeting sequence
ucuugguaaacuuuuuggug

SEQ ID NO: 47886 - RNA, 20 nt, Artificial Sequence
  CIITA targeting sequence
ugguaaacuuuuugguguuu

SEQ ID NO: 47887 - RNA, 20 nt, Artificial Sequence
  CIITA targeting sequence
auuguuuuauuaccagcacu

SEQ ID NO: 47888 - RNA, 20 nt, Artificial Sequence
  CIITA targeting sequence
cucaauuguuuuauuaccag

SEQ ID NO: 47889 - RNA, 20 nt, Artificial Sequence
  CIITA targeting sequence
acaucacucaauuguuuuau

SEQ ID NO: 47890 - RNA, 20 nt, Artificial Sequence
  CIITA targeting sequence
accugcgucuacaucacuca

SEQ ID NO: 47891 - RNA, 20 nt, Artificial Sequence
  CIITA targeting sequence
gcucuaccugcgucuacauc

SEQ ID NO: 47892 - RNA, 20 nt, Artificial Sequence
  CIITA targeting sequence
cuuucugcucuaccugcguc

SEQ ID NO: 47893 - RNA, 20 nt, Artificial Sequence
  CIITA targeting sequence
uccaaccucaguaucuuccu

SEQ ID NO: 47894 - RNA, 20 nt, Artificial Sequence
  CIITA targeting sequence
aaccucaguaucuuccucag

SEQ ID NO: 47895 - RNA, 20 nt, Artificial Sequence
  CIITA targeting sequence
guaucuuccucagagggaac

SEQ ID NO: 47896 - RNA, 20 nt, Artificial Sequence
  CIITA targeting sequence
uccucagagggaaccacugu

SEQ ID NO: 47897 - RNA, 20 nt, Artificial Sequence
  CIITA targeting sequence
ucagagggaaccacuguucu

SEQ ID NO: 47898 - RNA, 20 nt, Artificial Sequence
  CIITA targeting sequence
gagggaaccacuguucucag

SEQ ID NO: 47899 - RNA, 20 nt, Artificial Sequence
  CIITA targeting sequence
gaggaagauacugagguugg

SEQ ID NO: 47900 - RNA, 20 nt, Artificial Sequence
  CIITA targeting sequence
cucugaggaagauacugagg

SEQ ID NO: 47901 - RNA, 20 nt, Artificial Sequence
  CIITA targeting sequence
caguuuguauauucuuccag

SEQ ID NO: 47902 - RNA, 20 nt, Artificial Sequence
  CIITA targeting sequence
guuuguauauucuuccagac

SEQ ID NO: 47903 - RNA, 20 nt, Artificial Sequence
  CIITA targeting sequence
uccagaccuuucgcugugua

SEQ ID NO: 47904 - RNA, 20 nt, Artificial Sequence
  CIITA targeting sequence
agaccuuucgcuguguauuu

SEQ ID NO: 47905 - RNA, 20 nt, Artificial Sequence
  CIITA targeting sequence
ggaagaauauacaaacugag

SEQ ID NO: 47906 - RNA, 20 nt, Artificial Sequence
  CIITA targeting sequence
ucucccaggugccugaggcu

SEQ ID NO: 47907 - RNA, 20 nt, Artificial Sequence
  CIITA targeting sequence
ccacgcgcucaucucccagg

SEQ ID NO: 47908 - RNA, 20 nt, Artificial Sequence
  CIITA targeting sequence
caaaugccacagguuuaggu

SEQ ID NO: 47909 - RNA, 20 nt, Artificial Sequence
  CIITA targeting sequence
acaugucccaaaugccacag

SEQ ID NO: 47910 - RNA, 20 nt, Artificial Sequence
  CIITA targeting sequence
uugcagaauacuuuucccug

SEQ ID NO: 47911 - RNA, 20 nt, Artificial Sequence
  CIITA targeting sequence
gcaaagaaggucuacauguc

SEQ ID NO: 47912 - RNA, 20 nt, Artificial Sequence
  CIITA targeting sequence
cuggggcauguguuguguac

SEQ ID NO: 47913 - RNA, 20 nt, Artificial Sequence
  CIITA targeting sequence
acccaaacgccuugugauuu

SEQ ID NO: 47914 - RNA, 20 nt, Artificial Sequence
  CIITA targeting sequence
caaggcguuuggguugauuu

SEQ ID NO: 47915 - RNA, 20 nt, Artificial Sequence
  CIITA targeting sequence
uacucugaagugggcuuuuc

SEQ ID NO: 47916 - RNA, 20 nt, Artificial Sequence
  CIITA targeting sequence
gaagugggcuuuuccacuuc

SEQ ID NO: 47917 - RNA, 20 nt, Artificial Sequence
  CIITA targeting sequence
gaguaagaaaucacaaggcg

SEQ ID NO: 47918 - RNA, 20 nt, Artificial Sequence
  CIITA targeting sequence
acuucugguuaguuugggug

SEQ ID NO: 47919 - RNA, 20 nt, Artificial Sequence
  CIITA targeting sequence
gguuaguuugggugagcuug

SEQ ID NO: 47920 - RNA, 20 nt, Artificial Sequence
  CIITA targeting sequence
cccaaacuaaccagaagugg

SEQ ID NO: 47921 - RNA, 20 nt, Artificial Sequence
  CIITA targeting sequence
uucauucugcuacguuuagc

SEQ ID NO: 47922 - RNA, 20 nt, Artificial Sequence
  CIITA targeting sequence
guugcuccggucacccugcu

SEQ ID NO: 47923 - RNA, 20 nt, Artificial Sequence
  CIITA targeting sequence
caaaucucugcccacauuuc

SEQ ID NO: 47924 - RNA, 20 nt, Artificial Sequence
  CIITA targeting sequence
cugcccacauuucccagcca

SEQ ID NO: 47925 - RNA, 20 nt, Artificial Sequence
  CIITA targeting sequence
gcccacauuucccagccaaa

SEQ ID NO: 47926 - RNA, 20 nt, Artificial Sequence
  CIITA targeting sequence
cagccaaauucuaccagccu

SEQ ID NO: 47927 - RNA, 20 nt, Artificial Sequence
  CIITA targeting sequence
accagccucugcaugcuaac

SEQ ID NO: 47928 - RNA, 20 nt, Artificial Sequence
  CIITA targeting sequence
gcaugcuaacugugauguuu

SEQ ID NO: 47929 - RNA, 20 nt, Artificial Sequence
  CIITA targeting sequence
caguuagcaugcagaggcug

SEQ ID NO: 47930 - RNA, 20 nt, Artificial Sequence
  CIITA targeting sequence
gcuggguguggagcucaugu

SEQ ID NO: 47931 - RNA, 20 nt, Artificial Sequence
  CIITA targeting sequence
ugauuagaaaucucaaacca

SEQ ID NO: 47932 - RNA, 20 nt, Artificial Sequence
  CIITA targeting sequence
ugaacauauauuaacuuuau

SEQ ID NO: 47933 - RNA, 20 nt, Artificial Sequence
  CIITA targeting sequence
aaucaugaacauauauuaac

SEQ ID NO: 47934 - RNA, 20 nt, Artificial Sequence
  CIITA targeting sequence
caaaccaaaagguauaaaau

SEQ ID NO: 47935 - RNA, 20 nt, Artificial Sequence
  CIITA targeting sequence
aaccaaaagguauaaaauaa

SEQ ID NO: 47936 - RNA, 20 nt, Artificial Sequence
  CIITA targeting sequence
uggaaagaugccuaagaaug

SEQ ID NO: 47937 - RNA, 20 nt, Artificial Sequence
  CIITA targeting sequence
cauuuacaccaucacguaua

SEQ ID NO: 47938 - RNA, 20 nt, Artificial Sequence
  CIITA targeting sequence
cguauagccuuugaaaagcu

SEQ ID NO: 47939 - RNA, 20 nt, Artificial Sequence
  CIITA targeting sequence
aaggcuauacgugauggugu

SEQ ID NO: 47940 - RNA, 20 nt, Artificial Sequence
  CIITA targeting sequence
aguaaagcuuuucaaaggcu

SEQ ID NO: 47941 - RNA, 20 nt, Artificial Sequence
  CIITA targeting sequence
cuuucaaguaaagcuuuuca

SEQ ID NO: 47942 - RNA, 20 nt, Artificial Sequence
  CIITA targeting sequence
cuuccugcauuuucauccug

SEQ ID NO: 47943 - RNA, 20 nt, Artificial Sequence
  CIITA targeting sequence
guuuguccaaagggugggaa

SEQ ID NO: 47944 - RNA, 20 nt, Artificial Sequence
  CIITA targeting sequence
uaauuaccuaacaacucccc

SEQ ID NO: 47945 - RNA, 20 nt, Artificial Sequence
  CIITA targeting sequence
ccuaucaauggacauuuagg

SEQ ID NO: 47946 - RNA, 20 nt, Artificial Sequence
  CIITA targeting sequence
auggacauuuagguuauuuc

SEQ ID NO: 47947 - RNA, 20 nt, Artificial Sequence
  CIITA targeting sequence
auugauaggggaguuguuag

SEQ ID NO: 47948 - RNA, 20 nt, Artificial Sequence
  CIITA targeting sequence
aguuguuuacuggaaggucg

SEQ ID NO: 47949 - RNA, 20 nt, Artificial Sequence
  CIITA targeting sequence
aguaaacaacuggaaauaac

SEQ ID NO: 47950 - RNA, 20 nt, Artificial Sequence
  CIITA targeting sequence
uguuauaaagguuugaaauu

SEQ ID NO: 47951 - RNA, 20 nt, Artificial Sequence
  CIITA targeting sequence
aaccuuuauaacacgaccuu

SEQ ID NO: 47952 - RNA, 20 nt, Artificial Sequence
  CIITA targeting sequence
ccaguaagcaugcccuccca

SEQ ID NO: 47953 - RNA, 20 nt, Artificial Sequence
  CIITA targeting sequence
cacaccagacaccugaucac

SEQ ID NO: 47954 - RNA, 20 nt, Artificial Sequence
  CIITA targeting sequence
ggugugggagggcaugcuua

SEQ ID NO: 47955 - RNA, 20 nt, Artificial Sequence
  CIITA targeting sequence
ggugucuggugugggagggc

SEQ ID NO: 47956 - RNA, 20 nt, Artificial Sequence
  CIITA targeting sequence
cugagaaaaguagaucccuu

SEQ ID NO: 47957 - RNA, 20 nt, Artificial Sequence
  CIITA targeting sequence
gugaucaggugucuggugug

SEQ ID NO: 47958 - RNA, 20 nt, Artificial Sequence
  CIITA targeting sequence
cagugaucaggugucuggug

SEQ ID NO: 47959 - RNA, 20 nt, Artificial Sequence
  CIITA targeting sequence
acuuuucucagugaucaggu

SEQ ID NO: 47960 - RNA, 20 nt, Artificial Sequence
  CIITA targeting sequence
cuuuggaaaguuuuaaaauu

SEQ ID NO: 47961 - RNA, 20 nt, Artificial Sequence
  CIITA targeting sequence
aaagggaucuacuuuucuca

SEQ ID NO: 47962 - RNA, 20 nt, Artificial Sequence
  CIITA targeting sequence
uucuugcagcugauuuuuuu

SEQ ID NO: 47963 - RNA, 20 nt, Artificial Sequence
  CIITA targeting sequence
ugcagcugauuuuuuuuuuc

SEQ ID NO: 47964 - RNA, 20 nt, Artificial Sequence
  CIITA targeting sequence
gcugcaagaaugaauuuuaa

SEQ ID NO: 47965 - RNA, 20 nt, Artificial Sequence
  CIITA targeting sequence
uuuuuuagauguaagcagga

SEQ ID NO: 47966 - RNA, 20 nt, Artificial Sequence
  CIITA targeting sequence
aaaaaaagaaaaaaaaaauc

SEQ ID NO: 47967 - RNA, 20 nt, Artificial Sequence
  CIITA targeting sequence
guguggacucagacauacag

SEQ ID NO: 47968 - RNA, 20 nt, Artificial Sequence
  CIITA targeting sequence
cuaagcucuguguggacuca

SEQ ID NO: 47969 - RNA, 20 nt, Artificial Sequence
  CIITA targeting sequence
auaucugucugugugaauuu

SEQ ID NO: 47970 - RNA, 20 nt, Artificial Sequence
  CIITA targeting sequence
gucugugugaauuucugcuc

SEQ ID NO: 47971 - RNA, 20 nt, Artificial Sequence
  CIITA targeting sequence
gugugaauuucugcucuuaa

SEQ ID NO: 47972 - RNA, 20 nt, Artificial Sequence
  CIITA targeting sequence
cacagacagauauagaaccc

SEQ ID NO: 47973 - RNA, 20 nt, Artificial Sequence
  CIITA targeting sequence
gcucuuaauuucaaacuagg

SEQ ID NO: 47974 - RNA, 20 nt, Artificial Sequence
  CIITA targeting sequence
uaauuucaaacuaggggacg

SEQ ID NO: 47975 - RNA, 20 nt, Artificial Sequence
  CIITA targeting sequence
aacuaggggacguuuugccc

SEQ ID NO: 47976 - RNA, 20 nt, Artificial Sequence
  CIITA targeting sequence
ccuaguuugaaauuaagagc

SEQ ID NO: 47977 - RNA, 20 nt, Artificial Sequence
  CIITA targeting sequence
gaaauucacuaggaguuggc

SEQ ID NO: 47978 - RNA, 20 nt, Artificial Sequence
  CIITA targeting sequence
gagccggccacacagcaauc

SEQ ID NO: 47979 - RNA, 20 nt, Artificial Sequence
  CIITA targeting sequence
cuaggaguuggcagugaugg

SEQ ID NO: 47980 - RNA, 20 nt, Artificial Sequence
  CIITA targeting sequence
uagugaauuucagagccggc

SEQ ID NO: 47981 - RNA, 20 nt, Artificial Sequence
  CIITA targeting sequence
cugccaacuccuagugaauu

SEQ ID NO: 47982 - RNA, 20 nt, Artificial Sequence
  CIITA targeting sequence
caucacugccaacuccuagu

SEQ ID NO: 47983 - RNA, 20 nt, Artificial Sequence
  CIITA targeting sequence
ucccaucacugccaacuccu

SEQ ID NO: 47984 - RNA, 20 nt, Artificial Sequence
  CIITA targeting sequence
uggguuuggaugcuucagga

SEQ ID NO: 47985 - RNA, 20 nt, Artificial Sequence
  CIITA targeting sequence
aaacccaggaaguuagcuuc

SEQ ID NO: 47986 - RNA, 20 nt, Artificial Sequence
  CIITA targeting sequence
ggagaagaugagagggcgac

SEQ ID NO: 47987 - RNA, 20 nt, Artificial Sequence
  CIITA targeting sequence
ugaagcauccaaacccagga

SEQ ID NO: 47988 - RNA, 20 nt, Artificial Sequence
  CIITA targeting sequence
ccugaagcauccaaacccag

SEQ ID NO: 47989 - RNA, 20 nt, Artificial Sequence
  CIITA targeting sequence
aucacccggcauccuaagug

SEQ ID NO: 47990 - RNA, 20 nt, Artificial Sequence
  CIITA targeting sequence
aaugcagccuagucgcccuc

SEQ ID NO: 47991 - RNA, 20 nt, Artificial Sequence
  CIITA targeting sequence
cccggcauccuaagugggcu

SEQ ID NO: 47992 - RNA, 20 nt, Artificial Sequence
  CIITA targeting sequence
uaagugggcucugauggaug

SEQ ID NO: 47993 - RNA, 20 nt, Artificial Sequence
  CIITA targeting sequence
gauggaugcugucugucaag

SEQ ID NO: 47994 - RNA, 20 nt, Artificial Sequence
  CIITA targeting sequence
gagcccacuuaggaugccgg

SEQ ID NO: 47995 - RNA, 20 nt, Artificial Sequence
  CIITA targeting sequence
aucagagcccacuuaggaug

SEQ ID NO: 47996 - RNA, 20 nt, Artificial Sequence
  CIITA targeting sequence
gucaagcagugcauucucag

SEQ ID NO: 47997 - RNA, 20 nt, Artificial Sequence
  CIITA targeting sequence
agcagugcauucucagaacg

SEQ ID NO: 47998 - RNA, 20 nt, Artificial Sequence
  CIITA targeting sequence
cagaacgcucccaucugggg

SEQ ID NO: 47999 - RNA, 20 nt, Artificial Sequence
  CIITA targeting sequence
gaacgcucccaucugggggc

SEQ ID NO: 48000 - RNA, 20 nt, Artificial Sequence
  CIITA targeting sequence
gagaaugcacugcuugacag

SEQ ID NO: 48001 - RNA, 20 nt, Artificial Sequence
  CIITA targeting sequence
caucugggggcccucgguua

SEQ ID NO: 48002 - RNA, 20 nt, Artificial Sequence
  CIITA targeting sequence
gggggcccucgguuauuggc

SEQ ID NO: 48003 - RNA, 20 nt, Artificial Sequence
  CIITA targeting sequence
guuauuggcgucuguaauac

SEQ ID NO: 48004 - RNA, 20 nt, Artificial Sequence
  CIITA targeting sequence
guaauacgcuaucuggguuu

SEQ ID NO: 48005 - RNA, 20 nt, Artificial Sequence
  CIITA targeting sequence
ggguuuccuggacaguagaa

SEQ ID NO: 48006 - RNA, 20 nt, Artificial Sequence
  CIITA targeting sequence
uggacaguagaaucaugcag

SEQ ID NO: 48007 - RNA, 20 nt, Artificial Sequence
  CIITA targeting sequence
aggaaacccagauagcguau

SEQ ID NO: 48008 - RNA, 20 nt, Artificial Sequence
  CIITA targeting sequence
acuguccaggaaacccagau

SEQ ID NO: 48009 - RNA, 20 nt, Artificial Sequence
  CIITA targeting sequence
ugcagcaauuuaugugucau

SEQ ID NO: 48010 - RNA, 20 nt, Artificial Sequence
  CIITA targeting sequence
uuuuuuugugguugaauaau

SEQ ID NO: 48011 - RNA, 20 nt, Artificial Sequence
  CIITA targeting sequence
accacaaaaaaaugacacau

SEQ ID NO: 48012 - RNA, 20 nt, Artificial Sequence
  CIITA targeting sequence
acagugggcaaauaaaaauu

SEQ ID NO: 48013 - RNA, 20 nt, Artificial Sequence
  CIITA targeting sequence
aaauauaaacauuaauuuuu

SEQ ID NO: 48014 - RNA, 20 nt, Artificial Sequence
  CIITA targeting sequence
ccuuucaauuagguuuuguu

SEQ ID NO: 48015 - RNA, 20 nt, Artificial Sequence
  CIITA targeting sequence
auuagguuuuguuuugagcg

SEQ ID NO: 48016 - RNA, 20 nt, Artificial Sequence
  CIITA targeting sequence
aaacaaaaccuaauugaaag

SEQ ID NO: 48017 - RNA, 20 nt, Artificial Sequence
  CIITA targeting sequence
auaacgcucaaaacaaaacc

SEQ ID NO: 48018 - RNA, 20 nt, Artificial Sequence
  CIITA targeting sequence
guguuccuugagcacauuuc

SEQ ID NO: 48019 - RNA, 20 nt, Artificial Sequence
  CIITA targeting sequence
uugagcacauuuccauuuau

SEQ ID NO: 48020 - RNA, 20 nt, Artificial Sequence
  CIITA targeting sequence
aggaacacagauuaauuuca

SEQ ID NO: 48021 - RNA, 20 nt, Artificial Sequence
  CIITA targeting sequence
auuuauuggcaagguacggu

SEQ ID NO: 48022 - RNA, 20 nt, Artificial Sequence
  CIITA targeting sequence
ccagcauauaauuggugguc

SEQ ID NO: 48023 - RNA, 20 nt, Artificial Sequence
  CIITA targeting sequence
uuugggguaaauucagaugg

SEQ ID NO: 48024 - RNA, 20 nt, Artificial Sequence
  CIITA targeting sequence
gauggauaaucuauaucaag

SEQ ID NO: 48025 - RNA, 20 nt, Artificial Sequence
  CIITA targeting sequence
gaauuuaccccaaacgacca

SEQ ID NO: 48026 - RNA, 20 nt, Artificial Sequence
  CIITA targeting sequence
aucugaauuuaccccaaacg

SEQ ID NO: 48027 - RNA, 20 nt, Artificial Sequence
  CIITA targeting sequence
auaucaagauaauggaaaag

SEQ ID NO: 48028 - RNA, 20 nt, Artificial Sequence
  CIITA targeting sequence
agauaauggaaaaguuuauu

SEQ ID NO: 48029 - RNA, 20 nt, Artificial Sequence
  CIITA targeting sequence
ugauauagauuauccaucug

SEQ ID NO: 48030 - RNA, 20 nt, Artificial Sequence
  CIITA targeting sequence
auuaucuugauauagauuau

SEQ ID NO: 48031 - RNA, 20 nt, Artificial Sequence
  CIITA targeting sequence
aaauaaacuuuuccauuauc

SEQ ID NO: 48032 - RNA, 20 nt, Artificial Sequence
  CIITA targeting sequence
uuuuguaauuuaaaaaaagu

SEQ ID NO: 48033 - RNA, 20 nt, Artificial Sequence
  CIITA targeting sequence
gaacauuauuucagacucug

SEQ ID NO: 48034 - RNA, 20 nt, Artificial Sequence
  CIITA targeting sequence
gauaucauuuuguaauuuaa

SEQ ID NO: 48035 - RNA, 20 nt, Artificial Sequence
  CIITA targeting sequence
gacucugauaagagaaaaac

SEQ ID NO: 48036 - RNA, 20 nt, Artificial Sequence
  CIITA targeting sequence
gaaauaauguucagauauca

SEQ ID NO: 48037 - RNA, 20 nt, Artificial Sequence
  CIITA targeting sequence
gauaagagaaaaacacuuca

SEQ ID NO: 48038 - RNA, 20 nt, Artificial Sequence
  CIITA targeting sequence
gagucugaaauaauguucag

SEQ ID NO: 48039 - RNA, 20 nt, Artificial Sequence
  CIITA targeting sequence
uaucagagucugaaauaaug

SEQ ID NO: 48040 - RNA, 20 nt, Artificial Sequence
  CIITA targeting sequence
cuuaucagagucugaaauaa

SEQ ID NO: 48041 - RNA, 20 nt, Artificial Sequence
  CIITA targeting sequence
uuuuugagacaucucacucu

SEQ ID NO: 48042 - RNA, 20 nt, Artificial Sequence
  CIITA targeting sequence
aaaaagaaaauaaaaaaaaa

SEQ ID NO: 48043 - RNA, 20 nt, Artificial Sequence
  CIITA targeting sequence
caaaaaagaaaauaaaaaaa

SEQ ID NO: 48044 - RNA, 20 nt, Artificial Sequence
  CIITA targeting sequence
cacucugucuccugggcuag

SEQ ID NO: 48045 - RNA, 20 nt, Artificial Sequence
  CIITA targeting sequence
cucugucuccugggcuagag

SEQ ID NO: 48046 - RNA, 20 nt, Artificial Sequence
  CIITA targeting sequence
gucuccugggcuagagugca

SEQ ID NO: 48047 - RNA, 20 nt, Artificial Sequence
  CIITA targeting sequence
ccugggcuagagugcagugg

SEQ ID NO: 48048 - RNA, 20 nt, Artificial Sequence
  CIITA targeting sequence
ugggcuagagugcaguggcg

SEQ ID NO: 48049 - RNA, 20 nt, Artificial Sequence
  CIITA targeting sequence
agcccaggagacagagugag

SEQ ID NO: 48050 - RNA, 20 nt, Artificial Sequence
  CIITA targeting sequence
gccuccuuggcucgagcgau

SEQ ID NO: 48051 - RNA, 20 nt, Artificial Sequence
  CIITA targeting sequence
uuggcucgagcgauccuucu

SEQ ID NO: 48052 - RNA, 20 nt, Artificial Sequence
  CIITA targeting sequence
acauuuaaugcucuuuaaag

SEQ ID NO: 48053 - RNA, 20 nt, Artificial Sequence
  CIITA targeting sequence
uggugaaacacuguucuuuu

SEQ ID NO: 48054 - RNA, 20 nt, Artificial Sequence
  CIITA targeting sequence
ccaggagcuaaaacuuaauu

SEQ ID NO: 48055 - RNA, 20 nt, Artificial Sequence
  CIITA targeting sequence
uuuaggaagagugugagcuu

SEQ ID NO: 48056 - RNA, 20 nt, Artificial Sequence
  CIITA targeting sequence
uaaaagaacaguguuucacc

SEQ ID NO: 48057 - RNA, 20 nt, Artificial Sequence
  CIITA targeting sequence
uccuaaaagaacaguguuuc

SEQ ID NO: 48058 - RNA, 20 nt, Artificial Sequence
  CIITA targeting sequence
cacucuuccuaaaagaacag

SEQ ID NO: 48059 - RNA, 20 nt, Artificial Sequence
  CIITA targeting sequence
aaagcucacacucuuccuaa

SEQ ID NO: 48060 - RNA, 20 nt, Artificial Sequence
  CIITA targeting sequence
gcuccucuauuuucucaaug

SEQ ID NO: 48061 - RNA, 20 nt, Artificial Sequence
  CIITA targeting sequence
ucuauuuucucaaugauaaa

SEQ ID NO: 48062 - RNA, 20 nt, Artificial Sequence
  CIITA targeting sequence
auuuucucaaugauaaaaau

SEQ ID NO: 48063 - RNA, 20 nt, Artificial Sequence
  CIITA targeting sequence
caaugauaaaaaugggacug

SEQ ID NO: 48064 - RNA, 20 nt, Artificial Sequence
  CIITA targeting sequence
augauaaaaaugggacugau

SEQ ID NO: 48065 - RNA, 20 nt, Artificial Sequence
  CIITA targeting sequence
uugagaaaauagaggagcag

SEQ ID NO: 48066 - RNA, 20 nt, Artificial Sequence
  CIITA targeting sequence
cauuuuuaucauugagaaaa

SEQ ID NO: 48067 - RNA, 20 nt, Artificial Sequence
  CIITA targeting sequence
gucccauuuuuaucauugag

SEQ ID NO: 48068 - RNA, 20 nt, Artificial Sequence
  CIITA targeting sequence
uauauauuaugguuguuaua

SEQ ID NO: 48069 - RNA, 20 nt, Artificial Sequence
  CIITA targeting sequence
gacuuagggcaguagacagu

SEQ ID NO: 48070 - RNA, 20 nt, Artificial Sequence
  CIITA targeting sequence
gaaauggugcacuuuaccag

SEQ ID NO: 48071 - RNA, 20 nt, Artificial Sequence
  CIITA targeting sequence
acugcccuaagucagaaaug

SEQ ID NO: 48072 - RNA, 20 nt, Artificial Sequence
  CIITA targeting sequence
aaacaacagugccagcuacc

SEQ ID NO: 48073 - RNA, 20 nt, Artificial Sequence
  CIITA targeting sequence
aauaaucaaaacaacagugc

SEQ ID NO: 48074 - RNA, 20 nt, Artificial Sequence
  CIITA targeting sequence
ucaaauaaucaaaacaacag

SEQ ID NO: 48075 - RNA, 20 nt, Artificial Sequence
  CIITA targeting sequence
ucaucaaauaaucaaaacaa

SEQ ID NO: 48076 - RNA, 20 nt, Artificial Sequence
  CIITA targeting sequence
cagucucauuguccaucauc

SEQ ID NO: 48077 - RNA, 20 nt, Artificial Sequence
  CIITA targeting sequence
cauuguccaucaucccacac

SEQ ID NO: 48078 - RNA, 20 nt, Artificial Sequence
  CIITA targeting sequence
uuguccaucaucccacacuc

SEQ ID NO: 48079 - RNA, 20 nt, Artificial Sequence
  CIITA targeting sequence
aucaucccacacucugcugc

SEQ ID NO: 48080 - RNA, 20 nt, Artificial Sequence
  CIITA targeting sequence
ucccacacucugcugccaug

SEQ ID NO: 48081 - RNA, 20 nt, Artificial Sequence
  CIITA targeting sequence
cacacucugcugccaugugc

SEQ ID NO: 48082 - RNA, 20 nt, Artificial Sequence
  CIITA targeting sequence
gcugccaugugcacauguua

SEQ ID NO: 48083 - RNA, 20 nt, Artificial Sequence
  CIITA targeting sequence
ugcuuaugagaauaugcagu

SEQ ID NO: 48084 - RNA, 20 nt, Artificial Sequence
  CIITA targeting sequence
uaagcaggagcuaaauaaca

SEQ ID NO: 48085 - RNA, 20 nt, Artificial Sequence
  CIITA targeting sequence
cauaagcaggagcuaaauaa

SEQ ID NO: 48086 - RNA, 20 nt, Artificial Sequence
  CIITA targeting sequence
gaguuauuucacuuaagaua

SEQ ID NO: 48087 - RNA, 20 nt, Artificial Sequence
  CIITA targeting sequence
gacacuuacugcauauucuc

SEQ ID NO: 48088 - RNA, 20 nt, Artificial Sequence
  CIITA targeting sequence
cuuaagauaaucguccccau

SEQ ID NO: 48089 - RNA, 20 nt, Artificial Sequence
  CIITA targeting sequence
uaagugaaauaacucagaca

SEQ ID NO: 48090 - RNA, 20 nt, Artificial Sequence
  CIITA targeting sequence
uccccauguugcugcaaaau

SEQ ID NO: 48091 - RNA, 20 nt, Artificial Sequence
  CIITA targeting sequence
ccauguugcugcaaaauaca

SEQ ID NO: 48092 - RNA, 20 nt, Artificial Sequence
  CIITA targeting sequence
caauagcaaagacauggaau

SEQ ID NO: 48093 - RNA, 20 nt, Artificial Sequence
  CIITA targeting sequence
cgcaguaagcaugcgagugc

SEQ ID NO: 48094 - RNA, 20 nt, Artificial Sequence
  CIITA targeting sequence
caugcuuacugcgggacuau

SEQ ID NO: 48095 - RNA, 20 nt, Artificial Sequence
  CIITA targeting sequence
uaugauauaaugguuucuuu

SEQ ID NO: 48096 - RNA, 20 nt, Artificial Sequence
  CIITA targeting sequence
uaagauagcugcacucgcau

SEQ ID NO: 48097 - RNA, 20 nt, Artificial Sequence
  CIITA targeting sequence
uuuggagaugaguuucuuag

SEQ ID NO: 48098 - RNA, 20 nt, Artificial Sequence
  CIITA targeting sequence
aaaagaaaccauuauaucau

SEQ ID NO: 48099 - RNA, 20 nt, Artificial Sequence
  CIITA targeting sequence
ccaaaagaaaccauuauauc

SEQ ID NO: 48100 - RNA, 20 nt, Artificial Sequence
  CIITA targeting sequence
ucuccaaaagaaaccauuau

SEQ ID NO: 48101 - RNA, 20 nt, Artificial Sequence
  CIITA targeting sequence
uaggacagaaacuuuugggc

SEQ ID NO: 48102 - RNA, 20 nt, Artificial Sequence
  CIITA targeting sequence
aauucaccuguugccuucgu

SEQ ID NO: 48103 - RNA, 20 nt, Artificial Sequence
  CIITA targeting sequence
ccuguugccuucguuggacu

SEQ ID NO: 48104 - RNA, 20 nt, Artificial Sequence
  CIITA targeting sequence
uuggacuuuccuaggccaag

SEQ ID NO: 48105 - RNA, 20 nt, Artificial Sequence
  CIITA targeting sequence
aacgaaggcaacaggugaau

SEQ ID NO: 48106 - RNA, 20 nt, Artificial Sequence
  CIITA targeting sequence
uaggccaagcccagcauucg

SEQ ID NO: 48107 - RNA, 20 nt, Artificial Sequence
  CIITA targeting sequence
gugcuucauuaaacccaccg

SEQ ID NO: 48108 - RNA, 20 nt, Artificial Sequence
  CIITA targeting sequence
uuaaacccaccgagacacuc

SEQ ID NO: 48109 - RNA, 20 nt, Artificial Sequence
  CIITA targeting sequence
guggguuuaaugaagcaccg

SEQ ID NO: 48110 - RNA, 20 nt, Artificial Sequence
  CIITA targeting sequence
cgguggguuuaaugaagcac

SEQ ID NO: 48111 - RNA, 20 nt, Artificial Sequence
  CIITA targeting sequence
agcggucccuugagaugaac

SEQ ID NO: 48112 - RNA, 20 nt, Artificial Sequence
  CIITA targeting sequence
agugucucgguggguuuaau

SEQ ID NO: 48113 - RNA, 20 nt, Artificial Sequence
  CIITA targeting sequence
cuugagaugaacaagcacaa

SEQ ID NO: 48114 - RNA, 20 nt, Artificial Sequence
  CIITA targeting sequence
agggaccgcucgagugucuc

SEQ ID NO: 48115 - RNA, 20 nt, Artificial Sequence
  CIITA targeting sequence
caagggaccgcucgaguguc

SEQ ID NO: 48116 - RNA, 20 nt, Artificial Sequence
  CIITA targeting sequence
ucucaagggaccgcucgagu

SEQ ID NO: 48117 - RNA, 20 nt, Artificial Sequence
  CIITA targeting sequence
ugcccuugugcuuguucauc

SEQ ID NO: 48118 - RNA, 20 nt, Artificial Sequence
  CIITA targeting sequence
uuugcacccgccucuugccc

SEQ ID NO: 48119 - RNA, 20 nt, Artificial Sequence
  CIITA targeting sequence
cuuuugcacccgccucuugc

SEQ ID NO: 48120 - RNA, 20 nt, Artificial Sequence
  CIITA targeting sequence
ccaacguuuuuguaguuggg

SEQ ID NO: 48121 - RNA, 20 nt, Artificial Sequence
  CIITA targeting sequence
uccccaacguuuuuguaguu

SEQ ID NO: 48122 - RNA, 20 nt, Artificial Sequence
  CIITA targeting sequence
ucuuccccaacguuuuugua

SEQ ID NO: 48123 - RNA, 20 nt, Artificial Sequence
  CIITA targeting sequence
ucuucuuccccaacguuuuu

SEQ ID NO: 48124 - RNA, 20 nt, Artificial Sequence
  CIITA targeting sequence
ucuucuucuuccccaacguu

SEQ ID NO: 48125 - RNA, 20 nt, Artificial Sequence
  CIITA targeting sequence
ucaucuucuucuuccccaac

SEQ ID NO: 48126 - RNA, 20 nt, Artificial Sequence
  CIITA targeting sequence
ccucaucuucuucuucccca

SEQ ID NO: 48127 - RNA, 20 nt, Artificial Sequence
  CIITA targeting sequence
gugggcccuuucuccucauc

SEQ ID NO: 48128 - RNA, 20 nt, Artificial Sequence
  CIITA targeting sequence
ucggugggcccuuucuccuc

SEQ ID NO: 48129 - RNA, 20 nt, Artificial Sequence
  CIITA targeting sequence
ugggcauccucggugggccc

SEQ ID NO: 48130 - RNA, 20 nt, Artificial Sequence
  CIITA targeting sequence
ucuugggcauccucgguggg

SEQ ID NO: 48131 - RNA, 20 nt, Artificial Sequence
  CIITA targeting sequence
gcgucuucuugggcauccuc

SEQ ID NO: 48132 - RNA, 20 nt, Artificial Sequence
  CIITA targeting sequence
cggcgucuucuugggcaucc

SEQ ID NO: 48133 - RNA, 20 nt, Artificial Sequence
  CIITA targeting sequence
guaccuuuagccuucucggc

SEQ ID NO: 48134 - RNA, 20 nt, Artificial Sequence
  CIITA targeting sequence
aaaggcaucaagacgagugg

SEQ ID NO: 48135 - RNA, 20 nt, Artificial Sequence
  CIITA targeting sequence
agacgaguggggagagugaa

SEQ ID NO: 48136 - RNA, 20 nt, Artificial Sequence
  CIITA targeting sequence
ugaugccuuuugaaccaccc

SEQ ID NO: 48137 - RNA, 20 nt, Artificial Sequence
  CIITA targeting sequence
ucuugaugccuuuugaacca

SEQ ID NO: 48138 - RNA, 20 nt, Artificial Sequence
  CIITA targeting sequence
ccacucgucuugaugccuuu

SEQ ID NO: 48139 - RNA, 20 nt, Artificial Sequence
  CIITA targeting sequence
ccccacucgucuugaugccu

SEQ ID NO: 48140 - RNA, 20 nt, Artificial Sequence
  CIITA targeting sequence
cucuccccacucgucuugau

SEQ ID NO: 48141 - RNA, 20 nt, Artificial Sequence
  CIITA targeting sequence
ccuucacucuccccacucgu

SEQ ID NO: 48142 - RNA, 20 nt, Artificial Sequence
  CIITA targeting sequence
ccaugaacgccgcccugugc

SEQ ID NO: 48143 - RNA, 20 nt, Artificial Sequence
  CIITA targeting sequence
uggggacacucaccuucacu

SEQ ID NO: 48144 - RNA, 20 nt, Artificial Sequence
  CIITA targeting sequence
cuggcuggacacugugggga

SEQ ID NO: 48145 - RNA, 20 nt, Artificial Sequence
  CIITA targeting sequence
auuccuaccucacacuggcg

SEQ ID NO: 48146 - RNA, 20 nt, Artificial Sequence
  CIITA targeting sequence
aaucacuggcuggacacugu

SEQ ID NO: 48147 - RNA, 20 nt, Artificial Sequence
  CIITA targeting sequence
uaccucacacuggcguaccu

SEQ ID NO: 48148 - RNA, 20 nt, Artificial Sequence
  CIITA targeting sequence
cacuggcguaccucauucua

SEQ ID NO: 48149 - RNA, 20 nt, Artificial Sequence
  CIITA targeting sequence
uucuauacagcccugccacu

SEQ ID NO: 48150 - RNA, 20 nt, Artificial Sequence
  CIITA targeting sequence
auacagcccugccacucgga

SEQ ID NO: 48151 - RNA, 20 nt, Artificial Sequence
  CIITA targeting sequence
gaggcugcuguagguguaug

SEQ ID NO: 48152 - RNA, 20 nt, Artificial Sequence
  CIITA targeting sequence
gaguggcagggcuguauaga

SEQ ID NO: 48153 - RNA, 20 nt, Artificial Sequence
  CIITA targeting sequence
ugucuguuuagaaugaggug

SEQ ID NO: 48154 - RNA, 20 nt, Artificial Sequence
  CIITA targeting sequence
guuuagaaugaggugcacuc

SEQ ID NO: 48155 - RNA, 20 nt, Artificial Sequence
  CIITA targeting sequence
aaacagacaggacuuaaaaa

SEQ ID NO: 48156 - RNA, 20 nt, Artificial Sequence
  CIITA targeting sequence
uucuaaacagacaggacuua

SEQ ID NO: 48157 - RNA, 20 nt, Artificial Sequence
  CIITA targeting sequence
uguguaguacguaugugcuc

SEQ ID NO: 48158 - RNA, 20 nt, Artificial Sequence
  CIITA targeting sequence
guaagcaaaaucauucauuc

SEQ ID NO: 48159 - RNA, 20 nt, Artificial Sequence
  CIITA targeting sequence
ugggccaggcucacagccac

SEQ ID NO: 48160 - RNA, 20 nt, Artificial Sequence
  CIITA targeting sequence
cagccacacagcuggggucu

SEQ ID NO: 48161 - RNA, 20 nt, Artificial Sequence
  CIITA targeting sequence
cugcccgucguccugggcac

SEQ ID NO: 48162 - RNA, 20 nt, Artificial Sequence
  CIITA targeting sequence
gcccgucguccugggcacug

SEQ ID NO: 48163 - RNA, 20 nt, Artificial Sequence
  CIITA targeting sequence
uccugggcacuggggcuggg

SEQ ID NO: 48164 - RNA, 20 nt, Artificial Sequence
  CIITA targeting sequence
ugggcacuggggcugggggc

SEQ ID NO: 48165 - RNA, 20 nt, Artificial Sequence
  CIITA targeting sequence
gccaccaccuugcuugcucc

SEQ ID NO: 48166 - RNA, 20 nt, Artificial Sequence
  CIITA targeting sequence
aucaugacuuucuuggcagu

SEQ ID NO: 48167 - RNA, 20 nt, Artificial Sequence
  CIITA targeting sequence
ugacuuucuuggcaguuguc

SEQ ID NO: 48168 - RNA, 20 nt, Artificial Sequence
  CIITA targeting sequence
ugauggagcaagcaaggugg

SEQ ID NO: 48169 - RNA, 20 nt, Artificial Sequence
  CIITA targeting sequence
uggcaguugucagugaauac

SEQ ID NO: 48170 - RNA, 20 nt, Artificial Sequence
  CIITA targeting sequence
gugaauaccaugaucacauu

SEQ ID NO: 48171 - RNA, 20 nt, Artificial Sequence
  CIITA targeting sequence
cugacaacugccaagaaagu

SEQ ID NO: 48172 - RNA, 20 nt, Artificial Sequence
  CIITA targeting sequence
ugguauucacugacaacugc

SEQ ID NO: 48173 - RNA, 20 nt, Artificial Sequence
  CIITA targeting sequence
cauuucaacaagcguaacca

SEQ ID NO: 48174 - RNA, 20 nt, Artificial Sequence
  CIITA targeting sequence
acaagcguaaccaaaauguc

SEQ ID NO: 48175 - RNA, 20 nt, Artificial Sequence
  CIITA targeting sequence
caggccaaaaaugaauuccu

SEQ ID NO: 48176 - RNA, 20 nt, Artificial Sequence
  CIITA targeting sequence
cugugguggggaggggaagg

SEQ ID NO: 48177 - RNA, 20 nt, Artificial Sequence
  CIITA targeting sequence
ccaccacagugauauuuauu

SEQ ID NO: 48178 - RNA, 20 nt, Artificial Sequence
  CIITA targeting sequence
ccuccccaccacagugauau

SEQ ID NO: 48179 - RNA, 20 nt, Artificial Sequence
  CIITA targeting sequence
uucugauuauuuuguuguua

SEQ ID NO: 48180 - RNA, 20 nt, Artificial Sequence
  CIITA targeting sequence
gauuauuuuguuguuaaugc

SEQ ID NO: 48181 - RNA, 20 nt, Artificial Sequence
  CIITA targeting sequence
gaaugaccccaauaagcaaa

SEQ ID NO: 48182 - RNA, 20 nt, Artificial Sequence
  CIITA targeting sequence
cccaguguggcaacagaaca

SEQ ID NO: 48183 - RNA, 20 nt, Artificial Sequence
  CIITA targeting sequence
cccccaguguggcaacagaa

SEQ ID NO: 48184 - RNA, 20 nt, Artificial Sequence
  CIITA targeting sequence
auuucucccccaguguggca

SEQ ID NO: 48185 - RNA, 20 nt, Artificial Sequence
  CIITA targeting sequence
ucaccucauuuugugcauug

SEQ ID NO: 48186 - RNA, 20 nt, Artificial Sequence
  CIITA targeting sequence
ccucauuuugugcauugugu

SEQ ID NO: 48187 - RNA, 20 nt, Artificial Sequence
  CIITA targeting sequence
uuuugugcauuguguucuca

SEQ ID NO: 48188 - RNA, 20 nt, Artificial Sequence
  CIITA targeting sequence
caucgauuuuguuuuggaaa

SEQ ID NO: 48189 - RNA, 20 nt, Artificial Sequence
  CIITA targeting sequence
ucgauuuuguuuuggaaaga

SEQ ID NO: 48190 - RNA, 20 nt, Artificial Sequence
  CIITA targeting sequence
auuuuguuuuggaaagaugc

SEQ ID NO: 48191 - RNA, 20 nt, Artificial Sequence
  CIITA targeting sequence
augagaacacaaugcacaaa

SEQ ID NO: 48192 - RNA, 20 nt, Artificial Sequence
  CIITA targeting sequence
aaaacaaaaucgaugagaac

SEQ ID NO: 48193 - RNA, 20 nt, Artificial Sequence
  CIITA targeting sequence
uuccaaaacaaaaucgauga

SEQ ID NO: 48194 - RNA, 20 nt, Artificial Sequence
  CIITA targeting sequence
uucauuccaguccuuuuaag

SEQ ID NO: 48195 - RNA, 20 nt, Artificial Sequence
  CIITA targeting sequence
uuccaguccuuuuaaggaug

SEQ ID NO: 48196 - RNA, 20 nt, Artificial Sequence
  CIITA targeting sequence
aguccuuuuaaggaugcucu

SEQ ID NO: 48197 - RNA, 20 nt, Artificial Sequence
  CIITA targeting sequence
uuuuaaggaugcucucuaac

SEQ ID NO: 48198 - RNA, 20 nt, Artificial Sequence
  CIITA targeting sequence
uuaaaaggacuggaaugaaa

SEQ ID NO: 48199 - RNA, 20 nt, Artificial Sequence
  CIITA targeting sequence
cuaaccaggccucagcugug

SEQ ID NO: 48200 - RNA, 20 nt, Artificial Sequence
  CIITA targeting sequence
aaccaggccucagcugugac

SEQ ID NO: 48201 - RNA, 20 nt, Artificial Sequence
  CIITA targeting sequence
gcugugacuaacaguggugu

SEQ ID NO: 48202 - RNA, 20 nt, Artificial Sequence
  CIITA targeting sequence
cagcugaggccugguuagag

SEQ ID NO: 48203 - RNA, 20 nt, Artificial Sequence
  CIITA targeting sequence
acaccacuguuagucacagc

SEQ ID NO: 48204 - RNA, 20 nt, Artificial Sequence
  CIITA targeting sequence
gacaggcuuagccccaaaau

SEQ ID NO: 48205 - RNA, 20 nt, Artificial Sequence
  CIITA targeting sequence
gauccacaccacuguuaguc

SEQ ID NO: 48206 - RNA, 20 nt, Artificial Sequence
  CIITA targeting sequence
caaucaaauuagucagccag

SEQ ID NO: 48207 - RNA, 20 nt, Artificial Sequence
  CIITA targeting sequence
aauuagucagccagccagcc

SEQ ID NO: 48208 - RNA, 20 nt, Artificial Sequence
  CIITA targeting sequence
gccagccagcccaguccugg

SEQ ID NO: 48209 - RNA, 20 nt, Artificial Sequence
  CIITA targeting sequence
uggcacacaggggcuucagg

SEQ ID NO: 48210 - RNA, 20 nt, Artificial Sequence
  CIITA targeting sequence
ggccaguucugcaggcugcu

SEQ ID NO: 48211 - RNA, 20 nt, Artificial Sequence
  CIITA targeting sequence
caaugaccugugcaauuuug

SEQ ID NO: 48212 - RNA, 20 nt, Artificial Sequence
  CIITA targeting sequence
augaccugugcaauuuugau

SEQ ID NO: 48213 - RNA, 20 nt, Artificial Sequence
  CIITA targeting sequence
uugagagccaugugugacug

SEQ ID NO: 48214 - RNA, 20 nt, Artificial Sequence
  CIITA targeting sequence
aaauugcacaggucauugag

SEQ ID NO: 48215 - RNA, 20 nt, Artificial Sequence
  CIITA targeting sequence
uaauuucuugagcacauuag

SEQ ID NO: 48216 - RNA, 20 nt, Artificial Sequence
  CIITA targeting sequence
ugagcacauuagucauuuca

SEQ ID NO: 48217 - RNA, 20 nt, Artificial Sequence
  CIITA targeting sequence
agaaauuaggagggcaucaa

SEQ ID NO: 48218 - RNA, 20 nt, Artificial Sequence
  CIITA targeting sequence
uuucaaaauaugauggaucu

SEQ ID NO: 48219 - RNA, 20 nt, Artificial Sequence
  CIITA targeting sequence
aaauaugauggaucugucau

SEQ ID NO: 48220 - RNA, 20 nt, Artificial Sequence
  CIITA targeting sequence
uauuuugaaaugacuaaugu

SEQ ID NO: 48221 - RNA, 20 nt, Artificial Sequence
  CIITA targeting sequence
aucauauuuugaaaugacua

SEQ ID NO: 48222 - RNA, 20 nt, Artificial Sequence
  CIITA targeting sequence
gucauuuugucacucagcuc

SEQ ID NO: 48223 - RNA, 20 nt, Artificial Sequence
  CIITA targeting sequence
uuuugucacucagcucacca

SEQ ID NO: 48224 - RNA, 20 nt, Artificial Sequence
  CIITA targeting sequence
cucagcucaccauaaauaca

SEQ ID NO: 48225 - RNA, 20 nt, Artificial Sequence
  CIITA targeting sequence
gcucaccauaaauacauaca

SEQ ID NO: 48226 - RNA, 20 nt, Artificial Sequence
  CIITA targeting sequence
aaggagagaacacccaccaa

SEQ ID NO: 48227 - RNA, 20 nt, Artificial Sequence
  CIITA targeting sequence
guguuuggaugaaacugcac

SEQ ID NO: 48228 - RNA, 20 nt, Artificial Sequence
  CIITA targeting sequence
aaacacagauaccgucuaag

SEQ ID NO: 48229 - RNA, 20 nt, Artificial Sequence
  CIITA targeting sequence
uccaaacacagauaccgucu

SEQ ID NO: 48230 - RNA, 20 nt, Artificial Sequence
  CIITA targeting sequence
ugugagucggaaggguguca

SEQ ID NO: 48231 - RNA, 20 nt, Artificial Sequence
  CIITA targeting sequence
caggaauuaacagcugugca

SEQ ID NO: 48232 - RNA, 20 nt, Artificial Sequence
  CIITA targeting sequence
gaagggugucaggcacauuu

SEQ ID NO: 48233 - RNA, 20 nt, Artificial Sequence
  CIITA targeting sequence
gacucacaggaauuaacagc

SEQ ID NO: 48234 - RNA, 20 nt, Artificial Sequence
  CIITA targeting sequence
ggcacauuucuucauucaca

SEQ ID NO: 48235 - RNA, 20 nt, Artificial Sequence
  CIITA targeting sequence
ucauucacauugcauaccag

SEQ ID NO: 48236 - RNA, 20 nt, Artificial Sequence
  CIITA targeting sequence
uucacauugcauaccagaga

SEQ ID NO: 48237 - RNA, 20 nt, Artificial Sequence
  CIITA targeting sequence
cauugcauaccagagaacag

SEQ ID NO: 48238 - RNA, 20 nt, Artificial Sequence
  CIITA targeting sequence
cucaguaaaaaaugagaugc

SEQ ID NO: 48239 - RNA, 20 nt, Artificial Sequence
  CIITA targeting sequence
guaaaaaaugagaugcguuu

SEQ ID NO: 48240 - RNA, 20 nt, Artificial Sequence
  CIITA targeting sequence
uuuuuuacugagggagccac

SEQ ID NO: 48241 - RNA, 20 nt, Artificial Sequence
  CIITA targeting sequence
cauuuuuuacugagggagcc

SEQ ID NO: 48242 - RNA, 20 nt, Artificial Sequence
  CIITA targeting sequence
gaagcaaggggcagggaugc

SEQ ID NO: 48243 - RNA, 20 nt, Artificial Sequence
  CIITA targeting sequence
gauaaacgcaucucauuuuu

SEQ ID NO: 48244 - RNA, 20 nt, Artificial Sequence
  CIITA targeting sequence
cugccccuugcuucugauaa

SEQ ID NO: 48245 - RNA, 20 nt, Artificial Sequence
  CIITA targeting sequence
gcuggcccagcaucccugcc

SEQ ID NO: 48246 - RNA, 20 nt, Artificial Sequence
  CIITA targeting sequence
uuuaaagucaaaauuucacu

SEQ ID NO: 48247 - RNA, 20 nt, Artificial Sequence
  CIITA targeting sequence
ccgucuuuuaaagucaaaau

SEQ ID NO: 48248 - RNA, 20 nt, Artificial Sequence
  CIITA targeting sequence
uguauuuuccccgucuuuua

SEQ ID NO: 48249 - RNA, 20 nt, Artificial Sequence
  CIITA targeting sequence
cgaggcacaguuuugccaug

SEQ ID NO: 48250 - RNA, 20 nt, Artificial Sequence
  CIITA targeting sequence
ugaccacaugccuuuuuuac

SEQ ID NO: 48251 - RNA, 20 nt, Artificial Sequence
  CIITA targeting sequence
uggcaaaacugugccucgug

SEQ ID NO: 48252 - RNA, 20 nt, Artificial Sequence
  CIITA targeting sequence
aaauugggucauggcaaaac

SEQ ID NO: 48253 - RNA, 20 nt, Artificial Sequence
  CIITA targeting sequence
gggugcugcauuuauaaaaa

SEQ ID NO: 48254 - RNA, 20 nt, Artificial Sequence
  CIITA targeting sequence
caccuccuccagauuuaagc

SEQ ID NO: 48255 - RNA, 20 nt, Artificial Sequence
  CIITA targeting sequence
uccagauuuaagcucagaca

SEQ ID NO: 48256 - RNA, 20 nt, Artificial Sequence
  CIITA targeting sequence
agauuuaagcucagacaagg

SEQ ID NO: 48257 - RNA, 20 nt, Artificial Sequence
  CIITA targeting sequence
ggaggaggugugaauucugg

SEQ ID NO: 48258 - RNA, 20 nt, Artificial Sequence
  CIITA targeting sequence
gacaaggaaguugugugaaa

SEQ ID NO: 48259 - RNA, 20 nt, Artificial Sequence
  CIITA targeting sequence
gagcuuaaaucuggaggagg

SEQ ID NO: 48260 - RNA, 20 nt, Artificial Sequence
  CIITA targeting sequence
uugucugagcuuaaaucugg

SEQ ID NO: 48261 - RNA, 20 nt, Artificial Sequence
  CIITA targeting sequence
cacaacuuccuugucugagc

SEQ ID NO: 48262 - RNA, 20 nt, Artificial Sequence
  CIITA targeting sequence
uuucacacaacuuccuuguc

SEQ ID NO: 48263 - RNA, 20 nt, Artificial Sequence
  CIITA targeting sequence
acucccuuccccagucuaca

SEQ ID NO: 48264 - RNA, 20 nt, Artificial Sequence
  CIITA targeting sequence
cuuccccagucuacagagga

SEQ ID NO: 48265 - RNA, 20 nt, Artificial Sequence
  CIITA targeting sequence
ccagucuacagaggaauuug

SEQ ID NO: 48266 - RNA, 20 nt, Artificial Sequence
  CIITA targeting sequence
acagaggaauuugcucugcc

SEQ ID NO: 48267 - RNA, 20 nt, Artificial Sequence
  CIITA targeting sequence
guagacuggggaagggagug

SEQ ID NO: 48268 - RNA, 20 nt, Artificial Sequence
  CIITA targeting sequence
ucuguagacuggggaaggga

SEQ ID NO: 48269 - RNA, 20 nt, Artificial Sequence
  CIITA targeting sequence
gccucaggucccaaguaaug

SEQ ID NO: 48270 - RNA, 20 nt, Artificial Sequence
  CIITA targeting sequence
ggucccaaguaaugggugac

SEQ ID NO: 48271 - RNA, 20 nt, Artificial Sequence
  CIITA targeting sequence
caaguaaugggugacucauu

SEQ ID NO: 48272 - RNA, 20 nt, Artificial Sequence
  CIITA targeting sequence
cccauuacuugggaccugag

SEQ ID NO: 48273 - RNA, 20 nt, Artificial Sequence
  CIITA targeting sequence
uucugcaaccaagaaaucac

SEQ ID NO: 48274 - RNA, 20 nt, Artificial Sequence
  CIITA targeting sequence
gcaaccaagaaaucacaggg

SEQ ID NO: 48275 - RNA, 20 nt, Artificial Sequence
  CIITA targeting sequence
ugguugcagaaugagucacc

SEQ ID NO: 48276 - RNA, 20 nt, Artificial Sequence
  CIITA targeting sequence
cagggccccuaaauuugcag

SEQ ID NO: 48277 - RNA, 20 nt, Artificial Sequence
  CIITA targeting sequence
gcaaauuuaggggcccugug

SEQ ID NO: 48278 - RNA, 20 nt, Artificial Sequence
  CIITA targeting sequence
uuuuuuaguauuuaauuucu

SEQ ID NO: 48279 - RNA, 20 nt, Artificial Sequence
  CIITA targeting sequence
uucuuuuuuuaguauuuaau

SEQ ID NO: 48280 - RNA, 20 nt, Artificial Sequence
  CIITA targeting sequence
ucgucccuguaggcaaagaa

SEQ ID NO: 48281 - RNA, 20 nt, Artificial Sequence
  CIITA targeting sequence
ucccuguaggcaaagaagca

SEQ ID NO: 48282 - RNA, 20 nt, Artificial Sequence
  CIITA targeting sequence
cuguaggcaaagaagcauuc

SEQ ID NO: 48283 - RNA, 20 nt, Artificial Sequence
  CIITA targeting sequence
uugccuacagggacgaugau

SEQ ID NO: 48284 - RNA, 20 nt, Artificial Sequence
  CIITA targeting sequence
cucugcccaggaaggcagac

SEQ ID NO: 48285 - RNA, 20 nt, Artificial Sequence
  CIITA targeting sequence
gcccaggaaggcagacuucc

SEQ ID NO: 48286 - RNA, 20 nt, Artificial Sequence
  CIITA targeting sequence
ugggcagagugaaugcuucu

SEQ ID NO: 48287 - RNA, 20 nt, Artificial Sequence
  CIITA targeting sequence
gccuuccugggcagagugaa

SEQ ID NO: 48288 - RNA, 20 nt, Artificial Sequence
  CIITA targeting sequence
uaggguacgugcuuguuuuu

SEQ ID NO: 48289 - RNA, 20 nt, Artificial Sequence
  CIITA targeting sequence
agggcaagcuaaaaaacaag

SEQ ID NO: 48290 - RNA, 20 nt, Artificial Sequence
  CIITA targeting sequence
gaaaggacaguuaucucuuu

SEQ ID NO: 48291 - RNA, 20 nt, Artificial Sequence
  CIITA targeting sequence
gacucaagggcaagcuaaaa

SEQ ID NO: 48292 - RNA, 20 nt, Artificial Sequence
  CIITA targeting sequence
uuucagacucaagggcaagc

SEQ ID NO: 48293 - RNA, 20 nt, Artificial Sequence
  CIITA targeting sequence
cuuuuggaauuuacuuagag

SEQ ID NO: 48294 - RNA, 20 nt, Artificial Sequence
  CIITA targeting sequence
uuuggaauuuacuuagagca

SEQ ID NO: 48295 - RNA, 20 nt, Artificial Sequence
  CIITA targeting sequence
aaaagagauaacuguccuuu

SEQ ID NO: 48296 - RNA, 20 nt, Artificial Sequence
  CIITA targeting sequence
aaguaaauuccaaaagagau

SEQ ID NO: 48297 - RNA, 20 nt, Artificial Sequence
  CIITA targeting sequence
uauuccccucuugccaucuu

SEQ ID NO: 48298 - RNA, 20 nt, Artificial Sequence
  CIITA targeting sequence
ccucuugccaucuuuuuuca

SEQ ID NO: 48299 - RNA, 20 nt, Artificial Sequence
  CIITA targeting sequence
ugccaucuuuuuucagucug

SEQ ID NO: 48300 - RNA, 20 nt, Artificial Sequence
  CIITA targeting sequence
uuuuucagucuguccuugcu

SEQ ID NO: 48301 - RNA, 20 nt, Artificial Sequence
  CIITA targeting sequence
gucuguccuugcugugaucg

SEQ ID NO: 48302 - RNA, 20 nt, Artificial Sequence
  CIITA targeting sequence
guccuugcugugaucgcugg

SEQ ID NO: 48303 - RNA, 20 nt, Artificial Sequence
  CIITA targeting sequence
uugcugugaucgcuggaaua

SEQ ID NO: 48304 - RNA, 20 nt, Artificial Sequence
  CIITA targeting sequence
cagcaaggacagacugaaaa

SEQ ID NO: 48305 - RNA, 20 nt, Artificial Sequence
  CIITA targeting sequence
cuggaauauggaacacagag

SEQ ID NO: 48306 - RNA, 20 nt, Artificial Sequence
  CIITA targeting sequence
agcgaucacagcaaggacag

SEQ ID NO: 48307 - RNA, 20 nt, Artificial Sequence
  CIITA targeting sequence
auauuccagcgaucacagca

SEQ ID NO: 48308 - RNA, 20 nt, Artificial Sequence
  CIITA targeting sequence
guguuccauauuccagcgau

SEQ ID NO: 48309 - RNA, 20 nt, Artificial Sequence
  CIITA targeting sequence
guugcccucuguguuccaua

SEQ ID NO: 48310 - RNA, 20 nt, Artificial Sequence
  CIITA targeting sequence
caguugcccucuguguucca

SEQ ID NO: 48311 - RNA, 20 nt, Artificial Sequence
  CIITA targeting sequence
uugaauuugugaagucaaag

SEQ ID NO: 48312 - RNA, 20 nt, Artificial Sequence
  CIITA targeting sequence
aggauuuucucaguugcccu

SEQ ID NO: 48313 - RNA, 20 nt, Artificial Sequence
  CIITA targeting sequence
caaauucaaggauuuucuca

SEQ ID NO: 48314 - RNA, 20 nt, Artificial Sequence
  CIITA targeting sequence
aagacuauugggaggccaug

SEQ ID NO: 48315 - RNA, 20 nt, Artificial Sequence
  CIITA targeting sequence
uugacuucacaaauucaagg

SEQ ID NO: 48316 - RNA, 20 nt, Artificial Sequence
  CIITA targeting sequence
caauagucuuugacuucaca

SEQ ID NO: 48317 - RNA, 20 nt, Artificial Sequence
  CIITA targeting sequence
cugaaaagcacuucauuuac

SEQ ID NO: 48318 - RNA, 20 nt, Artificial Sequence
  CIITA targeting sequence
gggaaauggcaggcauggcc

SEQ ID NO: 48319 - RNA, 20 nt, Artificial Sequence
  CIITA targeting sequence
uuuaccaaauacuaaucaga

SEQ ID NO: 48320 - RNA, 20 nt, Artificial Sequence
  CIITA targeting sequence
gauucgaauggacaucagcc

SEQ ID NO: 48321 - RNA, 20 nt, Artificial Sequence
  CIITA targeting sequence
gauuaguauuugguaaauga

SEQ ID NO: 48322 - RNA, 20 nt, Artificial Sequence
  CIITA targeting sequence
aauggacaucagcccgggcg

SEQ ID NO: 48323 - RNA, 20 nt, Artificial Sequence
  CIITA targeting sequence
aaucugauuaguauuuggua

SEQ ID NO: 48324 - RNA, 20 nt, Artificial Sequence
  CIITA targeting sequence
auucgaaucugauuaguauu

SEQ ID NO: 48325 - RNA, 20 nt, Artificial Sequence
  CIITA targeting sequence
gcccgggcgaguuguuaaau

SEQ ID NO: 48326 - RNA, 20 nt, Artificial Sequence
  CIITA targeting sequence
cccgggcugauguccauucg

SEQ ID NO: 48327 - RNA, 20 nt, Artificial Sequence
  CIITA targeting sequence
aauuacagcaauaauuuaac

SEQ ID NO: 48328 - RNA, 20 nt, Artificial Sequence
  CIITA targeting sequence
uuuuucaaauuacagcaaua

SEQ ID NO: 48329 - RNA, 20 nt, Artificial Sequence
  CIITA targeting sequence
gaguaucagggaagcucaag

SEQ ID NO: 48330 - RNA, 20 nt, Artificial Sequence
  CIITA targeting sequence
gacacacucauuuuucaaau

SEQ ID NO: 48331 - RNA, 20 nt, Artificial Sequence
  CIITA targeting sequence
gggaagcucaagaaucuggc

SEQ ID NO: 48332 - RNA, 20 nt, Artificial Sequence
  CIITA targeting sequence
cugauacucugacacacuca

SEQ ID NO: 48333 - RNA, 20 nt, Artificial Sequence
  CIITA targeting sequence
agaaucuggccagagcuguc

SEQ ID NO: 48334 - RNA, 20 nt, Artificial Sequence
  CIITA targeting sequence
ugagcuucccugauacucug

SEQ ID NO: 48335 - RNA, 20 nt, Artificial Sequence
  CIITA targeting sequence
ggccagagcugucauuuaga

SEQ ID NO: 48336 - RNA, 20 nt, Artificial Sequence
  CIITA targeting sequence
ggccagauucuugagcuucc

SEQ ID NO: 48337 - RNA, 20 nt, Artificial Sequence
  CIITA targeting sequence
uuuagagaggcagaagugga

SEQ ID NO: 48338 - RNA, 20 nt, Artificial Sequence
  CIITA targeting sequence
aaaugacagcucuggccaga

SEQ ID NO: 48339 - RNA, 20 nt, Artificial Sequence
  CIITA targeting sequence
cuaaaugacagcucuggcca

SEQ ID NO: 48340 - RNA, 20 nt, Artificial Sequence
  CIITA targeting sequence
gccucucuaaaugacagcuc

SEQ ID NO: 48341 - RNA, 20 nt, Artificial Sequence
  CIITA targeting sequence
acuucugccucucuaaauga

SEQ ID NO: 48342 - RNA, 20 nt, Artificial Sequence
  CIITA targeting sequence
uugggugcugagggcccuca

SEQ ID NO: 48343 - RNA, 20 nt, Artificial Sequence
  CIITA targeting sequence
caaacuuuuuauuugaaaau

SEQ ID NO: 48344 - RNA, 20 nt, Artificial Sequence
  CIITA targeting sequence
aauaaaaaguuugggaaaau

SEQ ID NO: 48345 - RNA, 20 nt, Artificial Sequence
  CIITA targeting sequence
aauuuacaaaaggugcaaag

SEQ ID NO: 48346 - RNA, 20 nt, Artificial Sequence
  CIITA targeting sequence
uuauacuauuuuuggcuuug

SEQ ID NO: 48347 - RNA, 20 nt, Artificial Sequence
  CIITA targeting sequence
cacaaagacaaaaugaagga

SEQ ID NO: 48348 - RNA, 20 nt, Artificial Sequence
  CIITA targeting sequence
uugugauuagacugagauua

SEQ ID NO: 48349 - RNA, 20 nt, Artificial Sequence
  CIITA targeting sequence
caaggacacaucacacaaag

SEQ ID NO: 48350 - RNA, 20 nt, Artificial Sequence
  CIITA targeting sequence
aaucacaaggacacaucaca

SEQ ID NO: 48351 - RNA, 20 nt, Artificial Sequence
  CIITA targeting sequence
gucuaaucacaaggacacau

SEQ ID NO: 48352 - RNA, 20 nt, Artificial Sequence
  CIITA targeting sequence
cagucuaaucacaaggacac

SEQ ID NO: 48353 - RNA, 20 nt, Artificial Sequence
  CIITA targeting sequence
uggcuggaacacggcauggg

SEQ ID NO: 48354 - RNA, 20 nt, Artificial Sequence
  CIITA targeting sequence
agccaagaacgcauaaucuc

SEQ ID NO: 48355 - RNA, 20 nt, Artificial Sequence
  CIITA targeting sequence
cccaugccguguuccagcca

SEQ ID NO: 48356 - RNA, 20 nt, Artificial Sequence
  CIITA targeting sequence
ugcacuucucagggugucac

SEQ ID NO: 48357 - RNA, 20 nt, Artificial Sequence
  CIITA targeting sequence
cagggugucacaucuggagg

SEQ ID NO: 48358 - RNA, 20 nt, Artificial Sequence
  CIITA targeting sequence
gggugucacaucuggaggca

SEQ ID NO: 48359 - RNA, 20 nt, Artificial Sequence
  CIITA targeting sequence
caucuggaggcacaugaugu

SEQ ID NO: 48360 - RNA, 20 nt, Artificial Sequence
  CIITA targeting sequence
ggaggcacaugauguccuuc

SEQ ID NO: 48361 - RNA, 20 nt, Artificial Sequence
  CIITA targeting sequence
agaugugacacccugagaag

SEQ ID NO: 48362 - RNA, 20 nt, Artificial Sequence
  CIITA targeting sequence
ugugccuccagaugugacac

SEQ ID NO: 48363 - RNA, 20 nt, Artificial Sequence
  CIITA targeting sequence
uucugucccucuugggugau

SEQ ID NO: 48364 - RNA, 20 nt, Artificial Sequence
  CIITA targeting sequence
gucccucuugggugauguuc

SEQ ID NO: 48365 - RNA, 20 nt, Artificial Sequence
  CIITA targeting sequence
cucuugggugauguucguuu

SEQ ID NO: 48366 - RNA, 20 nt, Artificial Sequence
  CIITA targeting sequence
ugggugauguucguuuuggu

SEQ ID NO: 48367 - RNA, 20 nt, Artificial Sequence
  CIITA targeting sequence
cccaagagggacagaaggac

SEQ ID NO: 48368 - RNA, 20 nt, Artificial Sequence
  CIITA targeting sequence
uuuuggucacaugacuaagg

SEQ ID NO: 48369 - RNA, 20 nt, Artificial Sequence
  CIITA targeting sequence
caugacuaagguguugccca

SEQ ID NO: 48370 - RNA, 20 nt, Artificial Sequence
  CIITA targeting sequence
ugugaccaaaacgaacauca

SEQ ID NO: 48371 - RNA, 20 nt, Artificial Sequence
  CIITA targeting sequence
guauuguguaaugaccuucc

SEQ ID NO: 48372 - RNA, 20 nt, Artificial Sequence
  CIITA targeting sequence
cuuauugguguggacucaug

SEQ ID NO: 48373 - RNA, 20 nt, Artificial Sequence
  CIITA targeting sequence
uauugguguggacucaugga

SEQ ID NO: 48374 - RNA, 20 nt, Artificial Sequence
  CIITA targeting sequence
acaccaauaagagauaaaua

SEQ ID NO: 48375 - RNA, 20 nt, Artificial Sequence
  CIITA targeting sequence
uggauuccaauuuucuaaug

SEQ ID NO: 48376 - RNA, 20 nt, Artificial Sequence
  CIITA targeting sequence
augaguccacaccaauaaga

SEQ ID NO: 48377 - RNA, 20 nt, Artificial Sequence
  CIITA targeting sequence
aauuuucuaaugguuuauag

SEQ ID NO: 48378 - RNA, 20 nt, Artificial Sequence
  CIITA targeting sequence
aaugguuuauagugcauuac

SEQ ID NO: 48379 - RNA, 20 nt, Artificial Sequence
  CIITA targeting sequence
cagaguuggccugcaggaac

SEQ ID NO: 48380 - RNA, 20 nt, Artificial Sequence
  CIITA targeting sequence
gggacaauuuaagcaccaaa

SEQ ID NO: 48381 - RNA, 20 nt, Artificial Sequence
  CIITA targeting sequence
gugaguagacguuguuagga

SEQ ID NO: 48382 - RNA, 20 nt, Artificial Sequence
  CIITA targeting sequence
uauaaugcaccuaaaagcuu

SEQ ID NO: 48383 - RNA, 20 nt, Artificial Sequence
  CIITA targeting sequence
gaauugcuucacuuagaguu

SEQ ID NO: 48384 - RNA, 20 nt, Artificial Sequence
  CIITA targeting sequence
gaagcuuuuaggugcauuau

SEQ ID NO: 48385 - RNA, 20 nt, Artificial Sequence
  CIITA targeting sequence
cuuagaguuguuuauugcuu

SEQ ID NO: 48386 - RNA, 20 nt, Artificial Sequence
  CIITA targeting sequence
aagugaagcaauucugaagc

SEQ ID NO: 48387 - RNA, 20 nt, Artificial Sequence
  CIITA targeting sequence
ugguggugguggguuaaauc

SEQ ID NO: 48388 - RNA, 20 nt, Artificial Sequence
  CIITA targeting sequence
aggaauaaauguuugcaaag

SEQ ID NO: 48389 - RNA, 20 nt, Artificial Sequence
  CIITA targeting sequence
uugauuuaacccaccaccac

SEQ ID NO: 48390 - RNA, 20 nt, Artificial Sequence
  CIITA targeting sequence
cuuugcaaacauuuauuccu

SEQ ID NO: 48391 - RNA, 20 nt, Artificial Sequence
  CIITA targeting sequence
uaaggagcaccuccuuccug

SEQ ID NO: 48392 - RNA, 20 nt, Artificial Sequence
  CIITA targeting sequence
uuaugauuuuucacuuugca

SEQ ID NO: 48393 - RNA, 20 nt, Artificial Sequence
  CIITA targeting sequence
uuccugcacgagguucaaaa

SEQ ID NO: 48394 - RNA, 20 nt, Artificial Sequence
  CIITA targeting sequence
ugcacgagguucaaaaccaa

SEQ ID NO: 48395 - RNA, 20 nt, Artificial Sequence
  CIITA targeting sequence
ugcaggaaggaggugcuccu

SEQ ID NO: 48396 - RNA, 20 nt, Artificial Sequence
  CIITA targeting sequence
aguuuaggcuucuucuuucu

SEQ ID NO: 48397 - RNA, 20 nt, Artificial Sequence
  CIITA targeting sequence
ucuuucucauucucauugau

SEQ ID NO: 48398 - RNA, 20 nt, Artificial Sequence
  CIITA targeting sequence
uucucauucucauugauuua

SEQ ID NO: 48399 - RNA, 20 nt, Artificial Sequence
  CIITA targeting sequence
cauucucauugauuuaauuu

SEQ ID NO: 48400 - RNA, 20 nt, Artificial Sequence
  CIITA targeting sequence
uucucauugauuuaauuuuc

SEQ ID NO: 48401 - RNA, 20 nt, Artificial Sequence
  CIITA targeting sequence
cauugauuuaauuuucauuu

SEQ ID NO: 48402 - RNA, 20 nt, Artificial Sequence
  CIITA targeting sequence
uugauuuaauuuucauuuua

SEQ ID NO: 48403 - RNA, 20 nt, Artificial Sequence
  CIITA targeting sequence
augagaaugagaaagaagaa

SEQ ID NO: 48404 - RNA, 20 nt, Artificial Sequence
  CIITA targeting sequence
uuuuaaaaaugcauggaaua

SEQ ID NO: 48405 - RNA, 20 nt, Artificial Sequence
  CIITA targeting sequence
augcauuuuuaaaaugaaaa

SEQ ID NO: 48406 - RNA, 20 nt, Artificial Sequence
  CIITA targeting sequence
acuaugguacauacacacag

SEQ ID NO: 48407 - RNA, 20 nt, Artificial Sequence
  CIITA targeting sequence
aucggucuguuaugccuggg

SEQ ID NO: 48408 - RNA, 20 nt, Artificial Sequence
  CIITA targeting sequence
gucuguuaugccugggcauu

SEQ ID NO: 48409 - RNA, 20 nt, Artificial Sequence
  CIITA targeting sequence
guuaugccugggcauuuagg

SEQ ID NO: 48410 - RNA, 20 nt, Artificial Sequence
  CIITA targeting sequence
aguauuuugcaauuacaaag

SEQ ID NO: 48411 - RNA, 20 nt, Artificial Sequence
  CIITA targeting sequence
uuguaauugcaaaauacugg

SEQ ID NO: 48412 - RNA, 20 nt, Artificial Sequence
  CIITA targeting sequence
ugcggagaaagaccuacaag

SEQ ID NO: 48413 - RNA, 20 nt, Artificial Sequence
  CIITA targeting sequence
gcaagacacaccucuggaag

SEQ ID NO: 48414 - RNA, 20 nt, Artificial Sequence
  CIITA targeting sequence
ccgcaagacacaccucugga

SEQ ID NO: 48415 - RNA, 20 nt, Artificial Sequence
  CIITA targeting sequence
uucuccgcaagacacaccuc

SEQ ID NO: 48416 - RNA, 20 nt, Artificial Sequence
  CIITA targeting sequence
acaaccuagcagcccacuug

SEQ ID NO: 48417 - RNA, 20 nt, Artificial Sequence
  CIITA targeting sequence
ccguuauacucuacaaccua

SEQ ID NO: 48418 - RNA, 20 nt, Artificial Sequence
  CIITA targeting sequence
uuuuaagcuguauuuaagug

SEQ ID NO: 48419 - RNA, 20 nt, Artificial Sequence
  CIITA targeting sequence
ucuucuaaagaugauacuca

SEQ ID NO: 48420 - RNA, 20 nt, Artificial Sequence
  CIITA targeting sequence
ucuaaagaugauacucacuu

SEQ ID NO: 48421 - RNA, 20 nt, Artificial Sequence
  CIITA targeting sequence
aaagaugauacucacuuuag

SEQ ID NO: 48422 - RNA, 20 nt, Artificial Sequence
  CIITA targeting sequence
uuagaagaggacaucaaaga

SEQ ID NO: 48423 - RNA, 20 nt, Artificial Sequence
  CIITA targeting sequence
ucuuuagaagaggacaucaa

SEQ ID NO: 48424 - RNA, 20 nt, Artificial Sequence
  CIITA targeting sequence
cuuuagagcagugagaaucu

SEQ ID NO: 48425 - RNA, 20 nt, Artificial Sequence
  CIITA targeting sequence
aaagugaguaucaucuuuag

SEQ ID NO: 48426 - RNA, 20 nt, Artificial Sequence
  CIITA targeting sequence
cugcucuaaagugaguauca

SEQ ID NO: 48427 - RNA, 20 nt, Artificial Sequence
  CIITA targeting sequence
cacugcucuaaagugaguau

SEQ ID NO: 48428 - RNA, 20 nt, Artificial Sequence
  CIITA targeting sequence
ggggagcccuuucccccaaa

SEQ ID NO: 48429 - RNA, 20 nt, Artificial Sequence
  CIITA targeting sequence
ccagauucucacugcucuaa

SEQ ID NO: 48430 - RNA, 20 nt, Artificial Sequence
  CIITA targeting sequence
cccaaaaaccugcuaccaac

SEQ ID NO: 48431 - RNA, 20 nt, Artificial Sequence
  CIITA targeting sequence
acggcuucacacaaaacugc

SEQ ID NO: 48432 - RNA, 20 nt, Artificial Sequence
  CIITA targeting sequence
agaaaggggccucauggagu

SEQ ID NO: 48433 - RNA, 20 nt, Artificial Sequence
  CIITA targeting sequence
ggaauucuacggcuucacac

SEQ ID NO: 48434 - RNA, 20 nt, Artificial Sequence
  CIITA targeting sequence
uggagugcacgagggagccc

SEQ ID NO: 48435 - RNA, 20 nt, Artificial Sequence
  CIITA targeting sequence
augaggccccuuucuggaau

SEQ ID NO: 48436 - RNA, 20 nt, Artificial Sequence
  CIITA targeting sequence
ugcacuccaugaggccccuu

SEQ ID NO: 48437 - RNA, 20 nt, Artificial Sequence
  CIITA targeting sequence
cucgugcacuccaugaggcc

SEQ ID NO: 48438 - RNA, 20 nt, Artificial Sequence
  CIITA targeting sequence
gaggcauuugaugcccacca

SEQ ID NO: 48439 - RNA, 20 nt, Artificial Sequence
  CIITA targeting sequence
gacugccgugggcucccucg

SEQ ID NO: 48440 - RNA, 20 nt, Artificial Sequence
  CIITA targeting sequence
aaugccucugacugccgugg

SEQ ID NO: 48441 - RNA, 20 nt, Artificial Sequence
  CIITA targeting sequence
gcaccaagcucauccaacuu

SEQ ID NO: 48442 - RNA, 20 nt, Artificial Sequence
  CIITA targeting sequence
ucacccucuucucugcuccg

SEQ ID NO: 48443 - RNA, 20 nt, Artificial Sequence
  CIITA targeting sequence
cccucuucucugcuccggaa

SEQ ID NO: 48444 - RNA, 20 nt, Artificial Sequence
  CIITA targeting sequence
ucucugcuccggaauucugc

SEQ ID NO: 48445 - RNA, 20 nt, Artificial Sequence
  CIITA targeting sequence
cugcuccggaauucugcugg

SEQ ID NO: 48446 - RNA, 20 nt, Artificial Sequence
  CIITA targeting sequence
gcuccggaauucugcuggug

SEQ ID NO: 48447 - RNA, 20 nt, Artificial Sequence
  CIITA targeting sequence
ggaauucugcugguguccaa

SEQ ID NO: 48448 - RNA, 20 nt, Artificial Sequence
  CIITA targeting sequence
ggagcagagaagagggugaa

SEQ ID NO: 48449 - RNA, 20 nt, Artificial Sequence
  CIITA targeting sequence
gcugguguccaacgagauua

SEQ ID NO: 48450 - RNA, 20 nt, Artificial Sequence
  CIITA targeting sequence
aacgagauuaagccagaaag

SEQ ID NO: 48451 - RNA, 20 nt, Artificial Sequence
  CIITA targeting sequence
uuggacaccagcagaauucc

SEQ ID NO: 48452 - RNA, 20 nt, Artificial Sequence
  CIITA targeting sequence
cguuggacaccagcagaauu

SEQ ID NO: 48453 - RNA, 20 nt, Artificial Sequence
  CIITA targeting sequence
ggcuuaaucucguuggacac

SEQ ID NO: 48454 - RNA, 20 nt, Artificial Sequence
  CIITA targeting sequence
cccaaauauguguaaaaauu

SEQ ID NO: 48455 - RNA, 20 nt, Artificial Sequence
  CIITA targeting sequence
caaauauguguaaaaauuua

SEQ ID NO: 48456 - RNA, 20 nt, Artificial Sequence
  CIITA targeting sequence
uauuauauauaauuuauaau

SEQ ID NO: 48457 - RNA, 20 nt, Artificial Sequence
  CIITA targeting sequence
ugcuaguauuauggacagua

SEQ ID NO: 48458 - RNA, 20 nt, Artificial Sequence
  CIITA targeting sequence
auaauacuagcaugaucaua

SEQ ID NO: 48459 - RNA, 20 nt, Artificial Sequence
  CIITA targeting sequence
auuuuguuuuauacugucca

SEQ ID NO: 48460 - RNA, 20 nt, Artificial Sequence
  CIITA targeting sequence
uuuaaaaucuauuuuguuuu

SEQ ID NO: 48461 - RNA, 20 nt, Artificial Sequence
  CIITA targeting sequence
ucuuuuaaaaucuauuuugu

SEQ ID NO: 48462 - RNA, 20 nt, Artificial Sequence
  CIITA targeting sequence
caucuuuuaaaaucuauuuu

SEQ ID NO: 48463 - RNA, 20 nt, Artificial Sequence
  CIITA targeting sequence
uuuaacgcuucucaucuuuu

SEQ ID NO: 48464 - RNA, 20 nt, Artificial Sequence
  CIITA targeting sequence
cuaggcaguaggucuuuuaa

SEQ ID NO: 48465 - RNA, 20 nt, Artificial Sequence
  CIITA targeting sequence
ucuugcaugcccacugaggu

SEQ ID NO: 48466 - RNA, 20 nt, Artificial Sequence
  CIITA targeting sequence
ugcaugcccacugaggucca

SEQ ID NO: 48467 - RNA, 20 nt, Artificial Sequence
  CIITA targeting sequence
uugaauugacucacuuguuu

SEQ ID NO: 48468 - RNA, 20 nt, Artificial Sequence
  CIITA targeting sequence
aagaaagcuauccaguaaac

SEQ ID NO: 48469 - RNA, 20 nt, Artificial Sequence
  CIITA targeting sequence
auucaaagaaagcuauccag

SEQ ID NO: 48470 - RNA, 20 nt, Artificial Sequence
  CIITA targeting sequence
cuuguuuuuuucccaaaauu

SEQ ID NO: 48471 - RNA, 20 nt, Artificial Sequence
  CIITA targeting sequence
caaaauuuagccuuauucua

SEQ ID NO: 48472 - RNA, 20 nt, Artificial Sequence
  CIITA targeting sequence
aagcacuaauauccacagaa

SEQ ID NO: 48473 - RNA, 20 nt, Artificial Sequence
  CIITA targeting sequence
acagaaggcuuucugugcag

SEQ ID NO: 48474 - RNA, 20 nt, Artificial Sequence
  CIITA targeting sequence
guggauauuagugcuuagaa

SEQ ID NO: 48475 - RNA, 20 nt, Artificial Sequence
  CIITA targeting sequence
aagugguguguggacaaaug

SEQ ID NO: 48476 - RNA, 20 nt, Artificial Sequence
  CIITA targeting sequence
caccugugugauggggcccg

SEQ ID NO: 48477 - RNA, 20 nt, Artificial Sequence
  CIITA targeting sequence
cacaggugggagccaacagu

SEQ ID NO: 48478 - RNA, 20 nt, Artificial Sequence
  CIITA targeting sequence
cacagggcgggccccaucac

SEQ ID NO: 48479 - RNA, 20 nt, Artificial Sequence
  CIITA targeting sequence
cccacagggcgggccccauc

SEQ ID NO: 48480 - RNA, 20 nt, Artificial Sequence
  CIITA targeting sequence
gaucuuugacaucugacuuc

SEQ ID NO: 48481 - RNA, 20 nt, Artificial Sequence
  CIITA targeting sequence
gagucucccacagggcgggc

SEQ ID NO: 48482 - RNA, 20 nt, Artificial Sequence
  CIITA targeting sequence
uugacaucugacuucagauc

SEQ ID NO: 48483 - RNA, 20 nt, Artificial Sequence
  CIITA targeting sequence
caccaggucucuccuagcca

SEQ ID NO: 48484 - RNA, 20 nt, Artificial Sequence
  CIITA targeting sequence
cacaccaggucucuccuagc

SEQ ID NO: 48485 - RNA, 20 nt, Artificial Sequence
  CIITA targeting sequence
aggcagaggaaauuacugug

SEQ ID NO: 48486 - RNA, 20 nt, Artificial Sequence
  CIITA targeting sequence
gccuggaaggcucucacacc

SEQ ID NO: 48487 - RNA, 20 nt, Artificial Sequence
  CIITA targeting sequence
ucugccuggaaggcucucac

SEQ ID NO: 48488 - RNA, 20 nt, Artificial Sequence
  CIITA targeting sequence
uuacacaguaauuuccucug

SEQ ID NO: 48489 - RNA, 20 nt, Artificial Sequence
  CIITA targeting sequence
uuggauagaaacaagcuugg

SEQ ID NO: 48490 - RNA, 20 nt, Artificial Sequence
  CIITA targeting sequence
aaggaucuuuacacaguaau

SEQ ID NO: 48491 - RNA, 20 nt, Artificial Sequence
  CIITA targeting sequence
auccaaggaucuuuacacag

SEQ ID NO: 48492 - RNA, 20 nt, Artificial Sequence
  CIITA targeting sequence
cgccuguaaucccagcacuu

SEQ ID NO: 48493 - RNA, 20 nt, Artificial Sequence
  CIITA targeting sequence
cagcacuuugggaggccgag

SEQ ID NO: 48494 - RNA, 20 nt, Artificial Sequence
  CIITA targeting sequence
caaagugcugggauuacagg

SEQ ID NO: 48495 - RNA, 20 nt, Artificial Sequence
  CIITA targeting sequence
gccucccaaagugcugggau

SEQ ID NO: 48496 - RNA, 20 nt, Artificial Sequence
  CIITA targeting sequence
cggccucccaaagugcuggg

SEQ ID NO: 48497 - RNA, 20 nt, Artificial Sequence
  CIITA targeting sequence
gccugucucggccucccaaa

SEQ ID NO: 48498 - RNA, 20 nt, Artificial Sequence
  CIITA targeting sequence
ugaggucaggagauggagac

SEQ ID NO: 48499 - RNA, 20 nt, Artificial Sequence
  CIITA targeting sequence
ugaucugccugucucggccu

SEQ ID NO: 48500 - RNA, 20 nt, Artificial Sequence
  CIITA targeting sequence
ggagauggagaccauccugg

SEQ ID NO: 48501 - RNA, 20 nt, Artificial Sequence
  CIITA targeting sequence
ugaccucaugaucugccugu

SEQ ID NO: 48502 - RNA, 20 nt, Artificial Sequence
  CIITA targeting sequence
ccugaccucaugaucugccu

SEQ ID NO: 48503 - RNA, 20 nt, Artificial Sequence
  CIITA targeting sequence
aucuccugaccucaugaucu

SEQ ID NO: 48504 - RNA, 20 nt, Artificial Sequence
  CIITA targeting sequence
ccaucuccugaccucaugau

SEQ ID NO: 48505 - RNA, 20 nt, Artificial Sequence
  CIITA targeting sequence
uggccaacacggugaaaccc

SEQ ID NO: 48506 - RNA, 20 nt, Artificial Sequence
  CIITA targeting sequence
ccguguuggccaggaugguc

SEQ ID NO: 48507 - RNA, 20 nt, Artificial Sequence
  CIITA targeting sequence
guaauaaaaauacaaaagau

SEQ ID NO: 48508 - RNA, 20 nt, Artificial Sequence
  CIITA targeting sequence
caagcuugucuccauuuuuu

SEQ ID NO: 48509 - RNA, 20 nt, Artificial Sequence
  CIITA targeting sequence
agagauagugagaagcccag

SEQ ID NO: 48510 - RNA, 20 nt, Artificial Sequence
  CIITA targeting sequence
ugaacaucccaagcuugucu

SEQ ID NO: 48511 - RNA, 20 nt, Artificial Sequence
  CIITA targeting sequence
cuugaacaucccaagcuugu

SEQ ID NO: 48512 - RNA, 20 nt, Artificial Sequence
  CIITA targeting sequence
cuaucucuugaacaucccaa

SEQ ID NO: 48513 - RNA, 20 nt, Artificial Sequence
  CIITA targeting sequence
cacuaucucuugaacauccc

SEQ ID NO: 48514 - RNA, 20 nt, Artificial Sequence
  CIITA targeting sequence
agcugugcugggcuucucac

SEQ ID NO: 48515 - RNA, 20 nt, Artificial Sequence
  CIITA targeting sequence
ugcugcuccagcugugcugg

SEQ ID NO: 48516 - RNA, 20 nt, Artificial Sequence
  CIITA targeting sequence
cugccuggcuggcucaugcu

SEQ ID NO: 48517 - RNA, 20 nt, Artificial Sequence
  CIITA targeting sequence
uggccaucccugccuggcug

SEQ ID NO: 48518 - RNA, 20 nt, Artificial Sequence
  CIITA targeting sequence
gagguggacuggggccaggc

SEQ ID NO: 48519 - RNA, 20 nt, Artificial Sequence
  CIITA targeting sequence
gaccuuaccuccuggccauc

SEQ ID NO: 48520 - RNA, 20 nt, Artificial Sequence
  CIITA targeting sequence
accucugaccuuaccuccug

SEQ ID NO: 48521 - RNA, 20 nt, Artificial Sequence
  CIITA targeting sequence
aaacacacggccuggcccca

SEQ ID NO: 48522 - RNA, 20 nt, Artificial Sequence
  CIITA targeting sequence
ucuugagagugaugaguagg

SEQ ID NO: 48523 - RNA, 20 nt, Artificial Sequence
  CIITA targeting sequence
ugagagugaugaguaggcac

SEQ ID NO: 48524 - RNA, 20 nt, Artificial Sequence
  CIITA targeting sequence
agaugaaauccaaacacacg

SEQ ID NO: 48525 - RNA, 20 nt, Artificial Sequence
  CIITA targeting sequence
caagaugaaauccaaacaca

SEQ ID NO: 48526 - RNA, 20 nt, Artificial Sequence
  CIITA targeting sequence
cucucaagaugaaauccaaa

SEQ ID NO: 48527 - RNA, 20 nt, Artificial Sequence
  CIITA targeting sequence
ucacucucaagaugaaaucc

SEQ ID NO: 48528 - RNA, 20 nt, Artificial Sequence
  CIITA targeting sequence
cagugccuacucaucacucu

SEQ ID NO: 48529 - RNA, 20 nt, Artificial Sequence
  CIITA targeting sequence
aaacucccagugccuacuca

SEQ ID NO: 48530 - RNA, 20 nt, Artificial Sequence
  CIITA targeting sequence
guucaaaacucccagugccu

SEQ ID NO: 48531 - RNA, 20 nt, Artificial Sequence
  CIITA targeting sequence
ucuguucaaaacucccagug

SEQ ID NO: 48532 - RNA, 20 nt, Artificial Sequence
  CIITA targeting sequence
cuccucuguucaaaacuccc

SEQ ID NO: 48533 - RNA, 20 nt, Artificial Sequence
  CIITA targeting sequence
ugucacuccucuguucaaaa

SEQ ID NO: 48534 - RNA, 20 nt, Artificial Sequence
  CIITA targeting sequence
uuaaaaucacuuggguuugu

SEQ ID NO: 48535 - RNA, 20 nt, Artificial Sequence
  CIITA targeting sequence
cuuggguuuguguggagaau

SEQ ID NO: 48536 - RNA, 20 nt, Artificial Sequence
  CIITA targeting sequence
acacaaacccaagugauuuu

SEQ ID NO: 48537 - RNA, 20 nt, Artificial Sequence
  CIITA targeting sequence
ccacacaaacccaagugauu

SEQ ID NO: 48538 - RNA, 20 nt, Artificial Sequence
  CIITA targeting sequence
gccacccuaauguauucucc

SEQ ID NO: 48539 - RNA, 20 nt, Artificial Sequence
  CIITA targeting sequence
ucugccacccuaauguauuc

SEQ ID NO: 48540 - RNA, 20 nt, Artificial Sequence
  CIITA targeting sequence
gccaccucuucugccacccu

SEQ ID NO: 48541 - RNA, 20 nt, Artificial Sequence
  CIITA targeting sequence
aaagcuccuuacauuuuuuu

SEQ ID NO: 48542 - RNA, 20 nt, Artificial Sequence
  CIITA targeting sequence
gugagguugauuauguuuau

SEQ ID NO: 48543 - RNA, 20 nt, Artificial Sequence
  CIITA targeting sequence
cugacaacauucuaaagcuc

SEQ ID NO: 48544 - RNA, 20 nt, Artificial Sequence
  CIITA targeting sequence
accucacugacaacauucua

SEQ ID NO: 48545 - RNA, 20 nt, Artificial Sequence
  CIITA targeting sequence
accacaugucauaucuucuc

SEQ ID NO: 48546 - RNA, 20 nt, Artificial Sequence
  CIITA targeting sequence
uaucuucucagcugccugaa

SEQ ID NO: 48547 - RNA, 20 nt, Artificial Sequence
  CIITA targeting sequence
ucucagcugccugaaauccu

SEQ ID NO: 48548 - RNA, 20 nt, Artificial Sequence
  CIITA targeting sequence
cagcugccugaaauccuuug

SEQ ID NO: 48549 - RNA, 20 nt, Artificial Sequence
  CIITA targeting sequence
gcugccugaaauccuuuggg

SEQ ID NO: 48550 - RNA, 20 nt, Artificial Sequence
  CIITA targeting sequence
ggcagcugagaagauaugac

SEQ ID NO: 48551 - RNA, 20 nt, Artificial Sequence
  CIITA targeting sequence
uuugggaaggaaauguggua

SEQ ID NO: 48552 - RNA, 20 nt, Artificial Sequence
  CIITA targeting sequence
caaaggauuucaggcagcug

SEQ ID NO: 48553 - RNA, 20 nt, Artificial Sequence
  CIITA targeting sequence
uucccaaaggauuucaggca

SEQ ID NO: 48554 - RNA, 20 nt, Artificial Sequence
  CIITA targeting sequence
auaaaguaaaaaagacgauu

SEQ ID NO: 48555 - RNA, 20 nt, Artificial Sequence
  CIITA targeting sequence
uuuuuacuuuauugauacca

SEQ ID NO: 48556 - RNA, 20 nt, Artificial Sequence
  CIITA targeting sequence
ucuuuuuuacuuuauugaua

SEQ ID NO: 48557 - RNA, 20 nt, Artificial Sequence
  CIITA targeting sequence
ugguguugcugugaugaaug

SEQ ID NO: 48558 - RNA, 20 nt, Artificial Sequence
  CIITA targeting sequence
cagcaacaccaagaaacgug

SEQ ID NO: 48559 - RNA, 20 nt, Artificial Sequence
  CIITA targeting sequence
ucacagcaacaccaagaaac

SEQ ID NO: 48560 - RNA, 20 nt, Artificial Sequence
  CIITA targeting sequence
auucaucacagcaacaccaa

SEQ ID NO: 48561 - RNA, 20 nt, Artificial Sequence
  CIITA targeting sequence
uuccauucaucacagcaaca

SEQ ID NO: 48562 - RNA, 20 nt, Artificial Sequence
  CIITA targeting sequence
cuuuccauucaucacagcaa

SEQ ID NO: 48563 - RNA, 20 nt, Artificial Sequence
  CIITA targeting sequence
ggccucugucuuauuuccac

SEQ ID NO: 48564 - RNA, 20 nt, Artificial Sequence
  CIITA targeting sequence
gucuuauuuccaccccagug

SEQ ID NO: 48565 - RNA, 20 nt, Artificial Sequence
  CIITA targeting sequence
uauuuccaccccaguguguc

SEQ ID NO: 48566 - RNA, 20 nt, Artificial Sequence
  CIITA targeting sequence
accccagugugucucuggug

SEQ ID NO: 48567 - RNA, 20 nt, Artificial Sequence
  CIITA targeting sequence
gcccuagauuuauacacaug

SEQ ID NO: 48568 - RNA, 20 nt, Artificial Sequence
  CIITA targeting sequence
ggacucaucccagucuccau

SEQ ID NO: 48569 - RNA, 20 nt, Artificial Sequence
  CIITA targeting sequence
agacagcuuuucagcccuag

SEQ ID NO: 48570 - RNA, 20 nt, Artificial Sequence
  CIITA targeting sequence
ucccagucuccauuuuggcu

SEQ ID NO: 48571 - RNA, 20 nt, Artificial Sequence
  CIITA targeting sequence
cagucuccauuuuggcuucc

SEQ ID NO: 48572 - RNA, 20 nt, Artificial Sequence
  CIITA targeting sequence
ccauuuuggcuuccagagau

SEQ ID NO: 48573 - RNA, 20 nt, Artificial Sequence
  CIITA targeting sequence
auuuuggcuuccagagaucg

SEQ ID NO: 48574 - RNA, 20 nt, Artificial Sequence
  CIITA targeting sequence
agagaucgagauggugauca

SEQ ID NO: 48575 - RNA, 20 nt, Artificial Sequence
  CIITA targeting sequence
ggaagccaaaauggagacug

SEQ ID NO: 48576 - RNA, 20 nt, Artificial Sequence
  CIITA targeting sequence
cuggaagccaaaauggagac

SEQ ID NO: 48577 - RNA, 20 nt, Artificial Sequence
  CIITA targeting sequence
agauggugaucauggagcgu

SEQ ID NO: 48578 - RNA, 20 nt, Artificial Sequence
  CIITA targeting sequence
aucucuggaagccaaaaugg

SEQ ID NO: 48579 - RNA, 20 nt, Artificial Sequence
  CIITA targeting sequence
cgaucucuggaagccaaaau

SEQ ID NO: 48580 - RNA, 20 nt, Artificial Sequence
  CIITA targeting sequence
ccaucucgaucucuggaagc

SEQ ID NO: 48581 - RNA, 20 nt, Artificial Sequence
  CIITA targeting sequence
uggagcguagcaagcucuca

SEQ ID NO: 48582 - RNA, 20 nt, Artificial Sequence
  CIITA targeting sequence
augaucaccaucucgaucuc

SEQ ID NO: 48583 - RNA, 20 nt, Artificial Sequence
  CIITA targeting sequence
cagagcuggccgccagcacc

SEQ ID NO: 48584 - RNA, 20 nt, Artificial Sequence
  CIITA targeting sequence
gagcuggccgccagcaccuc

SEQ ID NO: 48585 - RNA, 20 nt, Artificial Sequence
  CIITA targeting sequence
gagagcuugcuacgcuccau

SEQ ID NO: 48586 - RNA, 20 nt, Artificial Sequence
  CIITA targeting sequence
gugcaggagcagaacaccac

SEQ ID NO: 48587 - RNA, 20 nt, Artificial Sequence
  CIITA targeting sequence
ugcacggaggugcuggcggc

SEQ ID NO: 48588 - RNA, 20 nt, Artificial Sequence
  CIITA targeting sequence
gcuccugcacggaggugcug

SEQ ID NO: 48589 - RNA, 20 nt, Artificial Sequence
  CIITA targeting sequence
gugguguucugcuccugcac

SEQ ID NO: 48590 - RNA, 20 nt, Artificial Sequence
  CIITA targeting sequence
uccgugguguucugcuccug

SEQ ID NO: 48591 - RNA, 20 nt, Artificial Sequence
  CIITA targeting sequence
ucguccgugguguucugcuc

SEQ ID NO: 48592 - RNA, 20 nt, Artificial Sequence
  CIITA targeting sequence
ccucguccgugguguucugc

SEQ ID NO: 48593 - RNA, 20 nt, Artificial Sequence
  CIITA targeting sequence
gagagcacgcaauggagcag

SEQ ID NO: 48594 - RNA, 20 nt, Artificial Sequence
  CIITA targeting sequence
gagcagguggcggcggcgcu

SEQ ID NO: 48595 - RNA, 20 nt, Artificial Sequence
  CIITA targeting sequence
cagagcagguggcggcggcg

SEQ ID NO: 48596 - RNA, 20 nt, Artificial Sequence
  CIITA targeting sequence
auugcgugcucucagagcag

SEQ ID NO: 48597 - RNA, 20 nt, Artificial Sequence
  CIITA targeting sequence
ggcagcuaccugcuccauug

SEQ ID NO: 48598 - RNA, 20 nt, Artificial Sequence
  CIITA targeting sequence
cgggcagcuaccugcuccau

SEQ ID NO: 48599 - RNA, 20 nt, Artificial Sequence
  CIITA targeting sequence
augcugagugcucucucagg

SEQ ID NO: 48600 - RNA, 20 nt, Artificial Sequence
  CIITA targeting sequence
accucucgggcagcuaccug

SEQ ID NO: 48601 - RNA, 20 nt, Artificial Sequence
  CIITA targeting sequence
gcaucgaccucucgggcagc

SEQ ID NO: 48602 - RNA, 20 nt, Artificial Sequence
  CIITA targeting sequence
cucagggaagaggagagggc

SEQ ID NO: 48603 - RNA, 20 nt, Artificial Sequence
  CIITA targeting sequence
cagggaagaggagagggcuc

SEQ ID NO: 48604 - RNA, 20 nt, Artificial Sequence
  CIITA targeting sequence
gggaagaggagagggcucag

SEQ ID NO: 48605 - RNA, 20 nt, Artificial Sequence
  CIITA targeting sequence
acaucuuauuugucucuuug

SEQ ID NO: 48606 - RNA, 20 nt, Artificial Sequence
  CIITA targeting sequence
uauuugucucuuugcuuggc

SEQ ID NO: 48607 - RNA, 20 nt, Artificial Sequence
  CIITA targeting sequence
cuuugcuuggcaaauguuuc

SEQ ID NO: 48608 - RNA, 20 nt, Artificial Sequence
  CIITA targeting sequence
uugcuuggcaaauguuucaa

SEQ ID NO: 48609 - RNA, 20 nt, Artificial Sequence
  CIITA targeting sequence
augacuuaacagaugggauu

SEQ ID NO: 48610 - RNA, 20 nt, Artificial Sequence
  CIITA targeting sequence
uugaaacauuugccaagcaa

SEQ ID NO: 48611 - RNA, 20 nt, Artificial Sequence
  CIITA targeting sequence
guuaagucauugaaacauuu

SEQ ID NO: 48612 - RNA, 20 nt, Artificial Sequence
  CIITA targeting sequence
caucuguuaagucauugaaa

SEQ ID NO: 48613 - RNA, 20 nt, Artificial Sequence
  CIITA targeting sequence
gaugugcaagggagccauuu

SEQ ID NO: 48614 - RNA, 20 nt, Artificial Sequence
  CIITA targeting sequence
gauaaaaauuaaucccaucu

SEQ ID NO: 48615 - RNA, 20 nt, Artificial Sequence
  CIITA targeting sequence
cuugcacaucugauaaaaau

SEQ ID NO: 48616 - RNA, 20 nt, Artificial Sequence
  CIITA targeting sequence
acuguuuuuuuauuuagcaa

SEQ ID NO: 48617 - RNA, 20 nt, Artificial Sequence
  CIITA targeting sequence
uuguacuccacuguuuuuuu

SEQ ID NO: 48618 - RNA, 20 nt, Artificial Sequence
  CIITA targeting sequence
aaaaggucuuuguacuccac

SEQ ID NO: 48619 - RNA, 20 nt, Artificial Sequence
  CIITA targeting sequence
cagcaaaaaauguaacuccc

SEQ ID NO: 48620 - RNA, 20 nt, Artificial Sequence
  CIITA targeting sequence
caaagcucugaaaaauaagu

SEQ ID NO: 48621 - RNA, 20 nt, Artificial Sequence
  CIITA targeting sequence
gaaaaauaaguaauucuaaa

SEQ ID NO: 48622 - RNA, 20 nt, Artificial Sequence
  CIITA targeting sequence
gagcuuugggaguuacauuu

SEQ ID NO: 48623 - RNA, 20 nt, Artificial Sequence
  CIITA targeting sequence
aaacacagacgguuggggac

SEQ ID NO: 48624 - RNA, 20 nt, Artificial Sequence
  CIITA targeting sequence
guguuuagaauuacuuauuu

SEQ ID NO: 48625 - RNA, 20 nt, Artificial Sequence
  CIITA targeting sequence
ccaaccgucuguguuuagaa

SEQ ID NO: 48626 - RNA, 20 nt, Artificial Sequence
  CIITA targeting sequence
uuagacuauaaauaauuaga

SEQ ID NO: 48627 - RNA, 20 nt, Artificial Sequence
  CIITA targeting sequence
agccugggcaacagaaugag

SEQ ID NO: 48628 - RNA, 20 nt, Artificial Sequence
  CIITA targeting sequence
guugcccaggcuggagugca

SEQ ID NO: 48629 - RNA, 20 nt, Artificial Sequence
  CIITA targeting sequence
uucuguugcccaggcuggag

SEQ ID NO: 48630 - RNA, 20 nt, Artificial Sequence
  CIITA targeting sequence
cauucuguugcccaggcugg

SEQ ID NO: 48631 - RNA, 20 nt, Artificial Sequence
  CIITA targeting sequence
cgcucagaauaucugcugcu

SEQ ID NO: 48632 - RNA, 20 nt, Artificial Sequence
  CIITA targeting sequence
cucagaauaucugcugcugc

SEQ ID NO: 48633 - RNA, 20 nt, Artificial Sequence
  CIITA targeting sequence
gaauaucugcugcugcuuuu

SEQ ID NO: 48634 - RNA, 20 nt, Artificial Sequence
  CIITA targeting sequence
gagcgagagucucauucugu

SEQ ID NO: 48635 - RNA, 20 nt, Artificial Sequence
  CIITA targeting sequence
gcugcugcuuuuaggugaau

SEQ ID NO: 48636 - RNA, 20 nt, Artificial Sequence
  CIITA targeting sequence
ccuaaaagcagcagcagaua

SEQ ID NO: 48637 - RNA, 20 nt, Artificial Sequence
  CIITA targeting sequence
ugauguguucaguuccuuag

SEQ ID NO: 48638 - RNA, 20 nt, Artificial Sequence
  CIITA targeting sequence
ugaagcacauggcuucuaau

SEQ ID NO: 48639 - RNA, 20 nt, Artificial Sequence
  CIITA targeting sequence
agaugcccaaaguuaagaaa

SEQ ID NO: 48640 - RNA, 20 nt, Artificial Sequence
  CIITA targeting sequence
aauggaagcugauucaguug

SEQ ID NO: 48641 - RNA, 20 nt, Artificial Sequence
  CIITA targeting sequence
auuagaagccaugugcuuca

SEQ ID NO: 48642 - RNA, 20 nt, Artificial Sequence
  CIITA targeting sequence
gcuuccauuagaagccaugu

SEQ ID NO: 48643 - RNA, 20 nt, Artificial Sequence
  CIITA targeting sequence
guugccuugaguuaggccgc

SEQ ID NO: 48644 - RNA, 20 nt, Artificial Sequence
  CIITA targeting sequence
aggcaacugaaucagcuucc

SEQ ID NO: 48645 - RNA, 20 nt, Artificial Sequence
  CIITA targeting sequence
uuucuuaaaaaaaaaaguuu

SEQ ID NO: 48646 - RNA, 20 nt, Artificial Sequence
  CIITA targeting sequence
uaaaaaaaaaaguuuaaaau

SEQ ID NO: 48647 - RNA, 20 nt, Artificial Sequence
  CIITA targeting sequence
uaauuuuaaacuuuuuuuuu

SEQ ID NO: 48648 - RNA, 20 nt, Artificial Sequence
  CIITA targeting sequence
uaaaaagcauaaagggggaa

SEQ ID NO: 48649 - RNA, 20 nt, Artificial Sequence
  CIITA targeting sequence
cccuuuaugcuuuuuaagau

SEQ ID NO: 48650 - RNA, 20 nt, Artificial Sequence
  CIITA targeting sequence
cguguguguuugaaauguua

SEQ ID NO: 48651 - RNA, 20 nt, Artificial Sequence
  CIITA targeting sequence
aacacacacgugacacacaa

SEQ ID NO: 48652 - RNA, 20 nt, Artificial Sequence
  CIITA targeting sequence
uaacauuucaaacacacacg

SEQ ID NO: 48653 - RNA, 20 nt, Artificial Sequence
  CIITA targeting sequence
uacuuuuuuuuuuugcauuu

SEQ ID NO: 48654 - RNA, 20 nt, Artificial Sequence
  CIITA targeting sequence
ggacccugccaaagugaaau

SEQ ID NO: 48655 - RNA, 20 nt, Artificial Sequence
  CIITA targeting sequence
ugacccagcaauuucucagg

SEQ ID NO: 48656 - RNA, 20 nt, Artificial Sequence
  CIITA targeting sequence
cuuuggcaggguccugaccc

SEQ ID NO: 48657 - RNA, 20 nt, Artificial Sequence
  CIITA targeting sequence
ugaaguagugcccuugguau

SEQ ID NO: 48658 - RNA, 20 nt, Artificial Sequence
  CIITA targeting sequence
ugauuucacuuuggcagggu

SEQ ID NO: 48659 - RNA, 20 nt, Artificial Sequence
  CIITA targeting sequence
auuuuuaauauaccaagggc

SEQ ID NO: 48660 - RNA, 20 nt, Artificial Sequence
  CIITA targeting sequence
aauagcagcucccaugcauu

SEQ ID NO: 48661 - RNA, 20 nt, Artificial Sequence
  CIITA targeting sequence
caugcauuggcaccguccac

SEQ ID NO: 48662 - RNA, 20 nt, Artificial Sequence
  CIITA targeting sequence
cggugcacaagggugaacac

SEQ ID NO: 48663 - RNA, 20 nt, Artificial Sequence
  CIITA targeting sequence
uacaugccccuccucuuuuc

SEQ ID NO: 48664 - RNA, 20 nt, Artificial Sequence
  CIITA targeting sequence
ucuuuuccagacccuuccug

SEQ ID NO: 48665 - RNA, 20 nt, Artificial Sequence
  CIITA targeting sequence
uuuccagacccuuccuggau

SEQ ID NO: 48666 - RNA, 20 nt, Artificial Sequence
  CIITA targeting sequence
agacccuuccuggauauggu

SEQ ID NO: 48667 - RNA, 20 nt, Artificial Sequence
  CIITA targeting sequence
ggaaaagaggaggggcaugu

SEQ ID NO: 48668 - RNA, 20 nt, Artificial Sequence
  CIITA targeting sequence
uggauaugguguaccacgcg

SEQ ID NO: 48669 - RNA, 20 nt, Artificial Sequence
  CIITA targeting sequence
aggaagggucuggaaaagag

SEQ ID NO: 48670 - RNA, 20 nt, Artificial Sequence
  CIITA targeting sequence
agcgcgugguacaccauauc

SEQ ID NO: 48671 - RNA, 20 nt, Artificial Sequence
  CIITA targeting sequence
gggcuguccagcgcguggua

SEQ ID NO: 48672 - RNA, 20 nt, Artificial Sequence
  CIITA targeting sequence
uccgggcuguccagcgcgug

SEQ ID NO: 48673 - RNA, 20 nt, Artificial Sequence
  CIITA targeting sequence
ucauccgggcuguccagcgc

SEQ ID NO: 48674 - RNA, 20 nt, Artificial Sequence
  CIITA targeting sequence
ugcucugccuccucuaugcc

SEQ ID NO: 48675 - RNA, 20 nt, Artificial Sequence
  CIITA targeting sequence
gccuccucuaugccaugucu

SEQ ID NO: 48676 - RNA, 20 nt, Artificial Sequence
  CIITA targeting sequence
ucuaugccaugucucauaau

SEQ ID NO: 48677 - RNA, 20 nt, Artificial Sequence
  CIITA targeting sequence
augccaugucucauaauaaa

SEQ ID NO: 48678 - RNA, 20 nt, Artificial Sequence
  CIITA targeting sequence
cauaauaaagguaagcaccc

SEQ ID NO: 48679 - RNA, 20 nt, Artificial Sequence
  CIITA targeting sequence
uaauaaagguaagcacccuu

SEQ ID NO: 48680 - RNA, 20 nt, Artificial Sequence
  CIITA targeting sequence
ggcaaggcaagggugcuuac

SEQ ID NO: 48681 - RNA, 20 nt, Artificial Sequence
  CIITA targeting sequence
uugcugggcccugcauaccc

SEQ ID NO: 48682 - RNA, 20 nt, Artificial Sequence
  CIITA targeting sequence
cgcuccucuuuagcuucuuu

SEQ ID NO: 48683 - RNA, 20 nt, Artificial Sequence
  CIITA targeting sequence
ucuuuagcuucuuuagaauu

SEQ ID NO: 48684 - RNA, 20 nt, Artificial Sequence
  CIITA targeting sequence
uuagcuucuuuagaauuucu

SEQ ID NO: 48685 - RNA, 20 nt, Artificial Sequence
  CIITA targeting sequence
uuagaauuucucagguguuu

SEQ ID NO: 48686 - RNA, 20 nt, Artificial Sequence
  CIITA targeting sequence
aaagaagcuaaagaggagcg

SEQ ID NO: 48687 - RNA, 20 nt, Artificial Sequence
  CIITA targeting sequence
cagguguuuuucuaccaacu

SEQ ID NO: 48688 - RNA, 20 nt, Artificial Sequence
  CIITA targeting sequence
gguguuuuucuaccaacuga

SEQ ID NO: 48689 - RNA, 20 nt, Artificial Sequence
  CIITA targeting sequence
accaacugaagccacaggaa

SEQ ID NO: 48690 - RNA, 20 nt, Artificial Sequence
  CIITA targeting sequence
guugguagaaaaacaccuga

SEQ ID NO: 48691 - RNA, 20 nt, Artificial Sequence
  CIITA targeting sequence
uguggcuucaguugguagaa

SEQ ID NO: 48692 - RNA, 20 nt, Artificial Sequence
  CIITA targeting sequence
ggcaauauggaggaagguga

SEQ ID NO: 48693 - RNA, 20 nt, Artificial Sequence
  CIITA targeting sequence
auauugccugaguaaccaau

SEQ ID NO: 48694 - RNA, 20 nt, Artificial Sequence
  CIITA targeting sequence
uccauauugccugaguaacc

SEQ ID NO: 48695 - RNA, 20 nt, Artificial Sequence
  CIITA targeting sequence
ccuuccuccauauugccuga

SEQ ID NO: 48696 - RNA, 20 nt, Artificial Sequence
  CIITA targeting sequence
agucaccuuccuccauauug

SEQ ID NO: 48697 - RNA, 20 nt, Artificial Sequence
  CIITA targeting sequence
uggguuaggcacucaaguca

SEQ ID NO: 48698 - RNA, 20 nt, Artificial Sequence
  CIITA targeting sequence
uccuggguuaggcacucaag

SEQ ID NO: 48699 - RNA, 20 nt, Artificial Sequence
  CIITA targeting sequence
cccugugguuuucuuuugac

SEQ ID NO: 48700 - RNA, 20 nt, Artificial Sequence
  CIITA targeting sequence
uuugaccccuugauuuacaa

SEQ ID NO: 48701 - RNA, 20 nt, Artificial Sequence
  CIITA targeting sequence
aaagaaaaccacagggugaa

SEQ ID NO: 48702 - RNA, 20 nt, Artificial Sequence
  CIITA targeting sequence
aggggucaaaagaaaaccac

SEQ ID NO: 48703 - RNA, 20 nt, Artificial Sequence
  CIITA targeting sequence
guuguaaaucaaggggucaa

SEQ ID NO: 48704 - RNA, 20 nt, Artificial Sequence
  CIITA targeting sequence
gaccucuuuccuaacaucag

SEQ ID NO: 48705 - RNA, 20 nt, Artificial Sequence
  CIITA targeting sequence
gacgcuaagucaguuguaaa

SEQ ID NO: 48706 - RNA, 20 nt, Artificial Sequence
  CIITA targeting sequence
uuccuaacaucagaacugaa

SEQ ID NO: 48707 - RNA, 20 nt, Artificial Sequence
  CIITA targeting sequence
uaacaucagaacugaaauca

SEQ ID NO: 48708 - RNA, 20 nt, Artificial Sequence
  CIITA targeting sequence
gaacugaaaucagucaaauu

SEQ ID NO: 48709 - RNA, 20 nt, Artificial Sequence
  CIITA targeting sequence
gauguuaggaaagaggucag

SEQ ID NO: 48710 - RNA, 20 nt, Artificial Sequence
  CIITA targeting sequence
guucugauguuaggaaagag

SEQ ID NO: 48711 - RNA, 20 nt, Artificial Sequence
  CIITA targeting sequence
gucaaauuguaaucuugguu

SEQ ID NO: 48712 - RNA, 20 nt, Artificial Sequence
  CIITA targeting sequence
aauuguaaucuugguuuugc

SEQ ID NO: 48713 - RNA, 20 nt, Artificial Sequence
  CIITA targeting sequence
ugguuuugcuauuuauaaca

SEQ ID NO: 48714 - RNA, 20 nt, Artificial Sequence
  CIITA targeting sequence
uauucuguguucagagcuga

SEQ ID NO: 48715 - RNA, 20 nt, Artificial Sequence
  CIITA targeting sequence
guguucagagcugaaauaga

SEQ ID NO: 48716 - RNA, 20 nt, Artificial Sequence
  CIITA targeting sequence
gagcugaaauagacccuggg

SEQ ID NO: 48717 - RNA, 20 nt, Artificial Sequence
  CIITA targeting sequence
gaacacagaauaagaacacc

SEQ ID NO: 48718 - RNA, 20 nt, Artificial Sequence
  CIITA targeting sequence
gcucugaacacagaauaaga

SEQ ID NO: 48719 - RNA, 20 nt, Artificial Sequence
  CIITA targeting sequence
auuucagcucugaacacaga

SEQ ID NO: 48720 - RNA, 20 nt, Artificial Sequence
  CIITA targeting sequence
acccagggucuauuucagcu

SEQ ID NO: 48721 - RNA, 20 nt, Artificial Sequence
  CIITA targeting sequence
accaaguccacccagggucu

SEQ ID NO: 48722 - RNA, 20 nt, Artificial Sequence
  CIITA targeting sequence
uuucugaagaaagguguggu

SEQ ID NO: 48723 - RNA, 20 nt, Artificial Sequence
  CIITA targeting sequence
gaagaaaggugugguucucu

SEQ ID NO: 48724 - RNA, 20 nt, Artificial Sequence
  CIITA targeting sequence
gaaaggaaaccuaugcuucc

SEQ ID NO: 48725 - RNA, 20 nt, Artificial Sequence
  CIITA targeting sequence
ucagaaaggaaaccuaugcu

SEQ ID NO: 48726 - RNA, 20 nt, Artificial Sequence
  CIITA targeting sequence
cuggcuuccccuauuaaggc

SEQ ID NO: 48727 - RNA, 20 nt, Artificial Sequence
  CIITA targeting sequence
ggcuuccccuauuaaggcua

SEQ ID NO: 48728 - RNA, 20 nt, Artificial Sequence
  CIITA targeting sequence
ccuauuaaggcuacuuggcc

SEQ ID NO: 48729 - RNA, 20 nt, Artificial Sequence
  CIITA targeting sequence
uggccaaguagccuuaauag

SEQ ID NO: 48730 - RNA, 20 nt, Artificial Sequence
  CIITA targeting sequence
aacucccaugggguugacag

SEQ ID NO: 48731 - RNA, 20 nt, Artificial Sequence
  CIITA targeting sequence
caugggguugacagguuuug

SEQ ID NO: 48732 - RNA, 20 nt, Artificial Sequence
  CIITA targeting sequence
auagagaacugccauucuuu

SEQ ID NO: 48733 - RNA, 20 nt, Artificial Sequence
  CIITA targeting sequence
auggaugugaacccaugugc

SEQ ID NO: 48734 - RNA, 20 nt, Artificial Sequence
  CIITA targeting sequence
cuauggaugugaacccaugu

SEQ ID NO: 48735 - RNA, 20 nt, Artificial Sequence
  CIITA targeting sequence
uuuuuaucaaugugugagca

SEQ ID NO: 48736 - RNA, 20 nt, Artificial Sequence
  CIITA targeting sequence
augugugagcaaaucauaga

SEQ ID NO: 48737 - RNA, 20 nt, Artificial Sequence
  CIITA targeting sequence
cacauugauaaaaaagaaug

SEQ ID NO: 48738 - RNA, 20 nt, Artificial Sequence
  CIITA targeting sequence
uagauauuaaggauuuuugc

SEQ ID NO: 48739 - RNA, 20 nt, Artificial Sequence
  CIITA targeting sequence
augauuugcucacacauuga

SEQ ID NO: 48740 - RNA, 20 nt, Artificial Sequence
  CIITA targeting sequence
uuaauaucuaugauuugcuc

SEQ ID NO: 48741 - RNA, 20 nt, Artificial Sequence
  CIITA targeting sequence
auguucaugacugauacugg

SEQ ID NO: 48742 - RNA, 20 nt, Artificial Sequence
  CIITA targeting sequence
ugacugauacuggucuguag

SEQ ID NO: 48743 - RNA, 20 nt, Artificial Sequence
  CIITA targeting sequence
ugaacauagaugcaaaaauc

SEQ ID NO: 48744 - RNA, 20 nt, Artificial Sequence
  CIITA targeting sequence
gucaugaacauagaugcaaa

SEQ ID NO: 48745 - RNA, 20 nt, Artificial Sequence
  CIITA targeting sequence
guagucuucuuguaauucuc

SEQ ID NO: 48746 - RNA, 20 nt, Artificial Sequence
  CIITA targeting sequence
ucuuguaauucucuugucug

SEQ ID NO: 48747 - RNA, 20 nt, Artificial Sequence
  CIITA targeting sequence
uguaauucucuugucugguu

SEQ ID NO: 48748 - RNA, 20 nt, Artificial Sequence
  CIITA targeting sequence
cuugucugguuuugcuauca

SEQ ID NO: 48749 - RNA, 20 nt, Artificial Sequence
  CIITA targeting sequence
ugucugguuuugcuaucagg

SEQ ID NO: 48750 - RNA, 20 nt, Artificial Sequence
  CIITA targeting sequence
gguuuugcuaucaggguuau

SEQ ID NO: 48751 - RNA, 20 nt, Artificial Sequence
  CIITA targeting sequence
ggguuaugcucaccuaauag

SEQ ID NO: 48752 - RNA, 20 nt, Artificial Sequence
  CIITA targeting sequence
ccuaauagaaugaauugaga

SEQ ID NO: 48753 - RNA, 20 nt, Artificial Sequence
  CIITA targeting sequence
cuauggcuaagugaacgcug

SEQ ID NO: 48754 - RNA, 20 nt, Artificial Sequence
  CIITA targeting sequence
cuuagccauagugagccauu

SEQ ID NO: 48755 - RNA, 20 nt, Artificial Sequence
  CIITA targeting sequence
gcguucacuuagccauagug

SEQ ID NO: 48756 - RNA, 20 nt, Artificial Sequence
  CIITA targeting sequence
uccagcgugagcuagaacag

SEQ ID NO: 48757 - RNA, 20 nt, Artificial Sequence
  CIITA targeting sequence
agcgugagcuagaacagacg

SEQ ID NO: 48758 - RNA, 20 nt, Artificial Sequence
  CIITA targeting sequence
cgcuggaggacccagucagc

SEQ ID NO: 48759 - RNA, 20 nt, Artificial Sequence
  CIITA targeting sequence
agcucacgcuggaggaccca

SEQ ID NO: 48760 - RNA, 20 nt, Artificial Sequence
  CIITA targeting sequence
guucuagcucacgcuggagg

SEQ ID NO: 48761 - RNA, 20 nt, Artificial Sequence
  CIITA targeting sequence
cuauggucaaguaaacagcg

SEQ ID NO: 48762 - RNA, 20 nt, Artificial Sequence
  CIITA targeting sequence
auggucaaguaaacagcgcg

SEQ ID NO: 48763 - RNA, 20 nt, Artificial Sequence
  CIITA targeting sequence
aguaaacagcgcgcgugcug

SEQ ID NO: 48764 - RNA, 20 nt, Artificial Sequence
  CIITA targeting sequence
ugcgcaaccccaccacaugg

SEQ ID NO: 48765 - RNA, 20 nt, Artificial Sequence
  CIITA targeting sequence
guagcugcaccacuagaaag

SEQ ID NO: 48766 - RNA, 20 nt, Artificial Sequence
  CIITA targeting sequence
aguggugcagcuacugauca

SEQ ID NO: 48767 - RNA, 20 nt, Artificial Sequence
  CIITA targeting sequence
uucuaguggugcagcuacug

SEQ ID NO: 48768 - RNA, 20 nt, Artificial Sequence
  CIITA targeting sequence
gccaucuuucuaguggugca

SEQ ID NO: 48769 - RNA, 20 nt, Artificial Sequence
  CIITA targeting sequence
uccgccaucuuucuaguggu

SEQ ID NO: 48770 - RNA, 20 nt, Artificial Sequence
  CIITA targeting sequence
uccuccgccaucuuucuagu

SEQ ID NO: 48771 - RNA, 20 nt, Artificial Sequence
  CIITA targeting sequence
uugcucuuccuccgccaucu

SEQ ID NO: 48772 - RNA, 20 nt, Artificial Sequence
  CIITA targeting sequence
cuuugguuccagaaaaucuc

SEQ ID NO: 48773 - RNA, 20 nt, Artificial Sequence
  CIITA targeting sequence
agaaaaucuccugaaaaaga

SEQ ID NO: 48774 - RNA, 20 nt, Artificial Sequence
  CIITA targeting sequence
ggaaccaaagggauuuuucu

SEQ ID NO: 48775 - RNA, 20 nt, Artificial Sequence
  CIITA targeting sequence
ccugaaaaagaggaaggcuu

SEQ ID NO: 48776 - RNA, 20 nt, Artificial Sequence
  CIITA targeting sequence
ugaaaaagaggaaggcuuau

SEQ ID NO: 48777 - RNA, 20 nt, Artificial Sequence
  CIITA targeting sequence
ggagauuuucuggaaccaaa

SEQ ID NO: 48778 - RNA, 20 nt, Artificial Sequence
  CIITA targeting sequence
uuuucaggagauuuucugga

SEQ ID NO: 48779 - RNA, 20 nt, Artificial Sequence
  CIITA targeting sequence
ucuuuuucaggagauuuucu

SEQ ID NO: 48780 - RNA, 20 nt, Artificial Sequence
  CIITA targeting sequence
ggcacucaaagccacccagg

SEQ ID NO: 48781 - RNA, 20 nt, Artificial Sequence
  CIITA targeting sequence
aagccacccaggcaaagcag

SEQ ID NO: 48782 - RNA, 20 nt, Artificial Sequence
  CIITA targeting sequence
ugcuuugccuggguggcuuu

SEQ ID NO: 48783 - RNA, 20 nt, Artificial Sequence
  CIITA targeting sequence
uugccaaaaguuccugcuuu

SEQ ID NO: 48784 - RNA, 20 nt, Artificial Sequence
  CIITA targeting sequence
uucuuugccaaaaguuccug

SEQ ID NO: 48785 - RNA, 20 nt, Artificial Sequence
  CIITA targeting sequence
gcuccuucuuugccaaaagu

SEQ ID NO: 48786 - RNA, 20 nt, Artificial Sequence
  CIITA targeting sequence
ucugcuccuucuuugccaaa

SEQ ID NO: 48787 - RNA, 20 nt, Artificial Sequence
  CIITA targeting sequence
uuucuucugcuccuucuuug

SEQ ID NO: 48788 - RNA, 20 nt, Artificial Sequence
  CIITA targeting sequence
gguuuaagcuacuggaauca

SEQ ID NO: 48789 - RNA, 20 nt, Artificial Sequence
  CIITA targeting sequence
aguagcuuaaaccugagccc

SEQ ID NO: 48790 - RNA, 20 nt, Artificial Sequence
  CIITA targeting sequence
uuccuacaugauuacuggca

SEQ ID NO: 48791 - RNA, 20 nt, Artificial Sequence
  CIITA targeting sequence
uacaugauuacuggcagcag

SEQ ID NO: 48792 - RNA, 20 nt, Artificial Sequence
  CIITA targeting sequence
uguaggaaugauuccaguag

SEQ ID NO: 48793 - RNA, 20 nt, Artificial Sequence
  CIITA targeting sequence
gcugccaguaaucauguagg

SEQ ID NO: 48794 - RNA, 20 nt, Artificial Sequence
  CIITA targeting sequence
gguuucugcugccaguaauc

SEQ ID NO: 48795 - RNA, 20 nt, Artificial Sequence
  CIITA targeting sequence
cagacgacuagaagugaaac

SEQ ID NO: 48796 - RNA, 20 nt, Artificial Sequence
  CIITA targeting sequence
gacgacuagaagugaaaccu

SEQ ID NO: 48797 - RNA, 20 nt, Artificial Sequence
  CIITA targeting sequence
gagaugcaccuugucagguu

SEQ ID NO: 48798 - RNA, 20 nt, Artificial Sequence
  CIITA targeting sequence
ucugagaugcaccuugucag

SEQ ID NO: 48799 - RNA, 20 nt, Artificial Sequence
  CIITA targeting sequence
agucgucugagaugcaccuu

SEQ ID NO: 48800 - RNA, 20 nt, Artificial Sequence
  CIITA targeting sequence
cuucuagucgucugagaugc

SEQ ID NO: 48801 - RNA, 20 nt, Artificial Sequence
  CIITA targeting sequence
ugccguggaauugccagaua

SEQ ID NO: 48802 - RNA, 20 nt, Artificial Sequence
  CIITA targeting sequence
acggcaugagguuucacuuc

SEQ ID NO: 48803 - RNA, 20 nt, Artificial Sequence
  CIITA targeting sequence
ggcaauuccacggcaugagg

SEQ ID NO: 48804 - RNA, 20 nt, Artificial Sequence
  CIITA targeting sequence
uuggccuuuguuguacgcau

SEQ ID NO: 48805 - RNA, 20 nt, Artificial Sequence
  CIITA targeting sequence
aaaggauugauggcgugagu

SEQ ID NO: 48806 - RNA, 20 nt, Artificial Sequence
  CIITA targeting sequence
augcguacaacaaaggccaa

SEQ ID NO: 48807 - RNA, 20 nt, Artificial Sequence
  CIITA targeting sequence
uuucgaugcguacaacaaag

SEQ ID NO: 48808 - RNA, 20 nt, Artificial Sequence
  CIITA targeting sequence
auccuuucgaugcguacaac

SEQ ID NO: 48809 - RNA, 20 nt, Artificial Sequence
  CIITA targeting sequence
cgccaucaauccuuucgaug

SEQ ID NO: 48810 - RNA, 20 nt, Artificial Sequence
  CIITA targeting sequence
gcaccaguaaacucacgcca

SEQ ID NO: 48811 - RNA, 20 nt, Artificial Sequence
  CIITA targeting sequence
cugcaccaguaaacucacgc

SEQ ID NO: 48812 - RNA, 20 nt, Artificial Sequence
  CIITA targeting sequence
ugcaaugguucucugcacca

SEQ ID NO: 48813 - RNA, 20 nt, Artificial Sequence
  CIITA targeting sequence
uuaggcaaagucuugcaaug

SEQ ID NO: 48814 - RNA, 20 nt, Artificial Sequence
  CIITA targeting sequence
uuguaaaagucaccccccag

SEQ ID NO: 48815 - RNA, 20 nt, Artificial Sequence
  CIITA targeting sequence
ccccccagaaucuacaaaug

SEQ ID NO: 48816 - RNA, 20 nt, Artificial Sequence
  CIITA targeting sequence
ggggggugacuuuuacaaag

SEQ ID NO: 48817 - RNA, 20 nt, Artificial Sequence
  CIITA targeting sequence
acaaaugcugcguauagugg

SEQ ID NO: 48818 - RNA, 20 nt, Artificial Sequence
  CIITA targeting sequence
acuauacgcagcauuuguag

SEQ ID NO: 48819 - RNA, 20 nt, Artificial Sequence
  CIITA targeting sequence
cauaaguuuccacuauacgc

SEQ ID NO: 48820 - RNA, 20 nt, Artificial Sequence
  CIITA targeting sequence
ccaggucacauaaguuucca

SEQ ID NO: 48821 - RNA, 20 nt, Artificial Sequence
  CIITA targeting sequence
aaaucugaagucuguccgag

SEQ ID NO: 48822 - RNA, 20 nt, Artificial Sequence
  CIITA targeting sequence
gaagucuguccgagaacuca

SEQ ID NO: 48823 - RNA, 20 nt, Artificial Sequence
  CIITA targeting sequence
gauuuggaaauccccagguc

SEQ ID NO: 48824 - RNA, 20 nt, Artificial Sequence
  CIITA targeting sequence
guccgagaacucauuuugaa

SEQ ID NO: 48825 - RNA, 20 nt, Artificial Sequence
  CIITA targeting sequence
gagaacucauuuugaaacgu

SEQ ID NO: 48826 - RNA, 20 nt, Artificial Sequence
  CIITA targeting sequence
gacagacuucagauuuggaa

SEQ ID NO: 48827 - RNA, 20 nt, Artificial Sequence
  CIITA targeting sequence
cggacagacuucagauuugg

SEQ ID NO: 48828 - RNA, 20 nt, Artificial Sequence
  CIITA targeting sequence
uuuugaaacguggacaagcc

SEQ ID NO: 48829 - RNA, 20 nt, Artificial Sequence
  CIITA targeting sequence
aaaugaguucucggacagac

SEQ ID NO: 48830 - RNA, 20 nt, Artificial Sequence
  CIITA targeting sequence
acguuucaaaaugaguucuc

SEQ ID NO: 48831 - RNA, 20 nt, Artificial Sequence
  CIITA targeting sequence
agaguaagaccaucccucug

SEQ ID NO: 48832 - RNA, 20 nt, Artificial Sequence
  CIITA targeting sequence
ugaccuuggcuuguccacgu

SEQ ID NO: 48833 - RNA, 20 nt, Artificial Sequence
  CIITA targeting sequence
uacucuugaccuuggcuugu

SEQ ID NO: 48834 - RNA, 20 nt, Artificial Sequence
  CIITA targeting sequence
cucugacagacaacacagug

SEQ ID NO: 48835 - RNA, 20 nt, Artificial Sequence
  CIITA targeting sequence
gacagacaacacagugauug

SEQ ID NO: 48836 - RNA, 20 nt, Artificial Sequence
  CIITA targeting sequence
gagggauggucuuacucuug

SEQ ID NO: 48837 - RNA, 20 nt, Artificial Sequence
  CIITA targeting sequence
gucagagggauggucuuacu

SEQ ID NO: 48838 - RNA, 20 nt, Artificial Sequence
  CIITA targeting sequence
cuguguugucugucagaggg

SEQ ID NO: 48839 - RNA, 20 nt, Artificial Sequence
  CIITA targeting sequence
aucacuguguugucugucag

SEQ ID NO: 48840 - RNA, 20 nt, Artificial Sequence
  CIITA targeting sequence
ucaaucacuguguugucugu

SEQ ID NO: 48841 - RNA, 20 nt, Artificial Sequence
  CIITA targeting sequence
ccaggugcuccucaaucacu

SEQ ID NO: 48842 - RNA, 20 nt, Artificial Sequence
  CIITA targeting sequence
uuugcuuggaagaccucauu

SEQ ID NO: 48843 - RNA, 20 nt, Artificial Sequence
  CIITA targeting sequence
aagcaaaugaugccaaacuu

SEQ ID NO: 48844 - RNA, 20 nt, Artificial Sequence
  CIITA targeting sequence
uccaagcaaaugaugccaaa

SEQ ID NO: 48845 - RNA, 20 nt, Artificial Sequence
  CIITA targeting sequence
uucaugaaauugcauuccca

SEQ ID NO: 48846 - RNA, 20 nt, Artificial Sequence
  CIITA targeting sequence
ugaaauugcauucccaggga

SEQ ID NO: 48847 - RNA, 20 nt, Artificial Sequence
  CIITA targeting sequence
ugaaugaggucuuccaagca

SEQ ID NO: 48848 - RNA, 20 nt, Artificial Sequence
  CIITA targeting sequence
cagggaagcauuuccaggag

SEQ ID NO: 48849 - RNA, 20 nt, Artificial Sequence
  CIITA targeting sequence
cugggaaugcaauuucauga

SEQ ID NO: 48850 - RNA, 20 nt, Artificial Sequence
  CIITA targeting sequence
aggagaucucaugguucuug

SEQ ID NO: 48851 - RNA, 20 nt, Artificial Sequence
  CIITA targeting sequence
uggaaaugcuucccugggaa

SEQ ID NO: 48852 - RNA, 20 nt, Artificial Sequence
  CIITA targeting sequence
ccuggaaaugcuucccuggg

SEQ ID NO: 48853 - RNA, 20 nt, Artificial Sequence
  CIITA targeting sequence
caugguucuugcgcccuuuc

SEQ ID NO: 48854 - RNA, 20 nt, Artificial Sequence
  CIITA targeting sequence
ugguucuugcgcccuuucca

SEQ ID NO: 48855 - RNA, 20 nt, Artificial Sequence
  CIITA targeting sequence
ugcgcccuuuccaccucuca

SEQ ID NO: 48856 - RNA, 20 nt, Artificial Sequence
  CIITA targeting sequence
accucucaguggcccaucau

SEQ ID NO: 48857 - RNA, 20 nt, Artificial Sequence
  CIITA targeting sequence
caguggcccaucaugcuacc

SEQ ID NO: 48858 - RNA, 20 nt, Artificial Sequence
  CIITA targeting sequence
guggcccaucaugcuaccaa

SEQ ID NO: 48859 - RNA, 20 nt, Artificial Sequence
  CIITA targeting sequence
ugcuaccaaaaauagagugg

SEQ ID NO: 48860 - RNA, 20 nt, Artificial Sequence
  CIITA targeting sequence
auuuuugguagcaugauggg

SEQ ID NO: 48861 - RNA, 20 nt, Artificial Sequence
  CIITA targeting sequence
ucaaggagaugggcacacuu

SEQ ID NO: 48862 - RNA, 20 nt, Artificial Sequence
  CIITA targeting sequence
aggagaugggcacacuuggc

SEQ ID NO: 48863 - RNA, 20 nt, Artificial Sequence
  CIITA targeting sequence
uugaggaagcccacucuauu

SEQ ID NO: 48864 - RNA, 20 nt, Artificial Sequence
  CIITA targeting sequence
ccuugaggaagcccacucua

SEQ ID NO: 48865 - RNA, 20 nt, Artificial Sequence
  CIITA targeting sequence
gggugaacgcaucaaucagc

SEQ ID NO: 48866 - RNA, 20 nt, Artificial Sequence
  CIITA targeting sequence
ccccgauagccaagugugcc

SEQ ID NO: 48867 - RNA, 20 nt, Artificial Sequence
  CIITA targeting sequence
aucagcucauccgccagcug

SEQ ID NO: 48868 - RNA, 20 nt, Artificial Sequence
  CIITA targeting sequence
gcucauccgccagcugaacu

SEQ ID NO: 48869 - RNA, 20 nt, Artificial Sequence
  CIITA targeting sequence
uccgccagcugaacuagacc

SEQ ID NO: 48870 - RNA, 20 nt, Artificial Sequence
  CIITA targeting sequence
gccagcugaacuagacccag

SEQ ID NO: 48871 - RNA, 20 nt, Artificial Sequence
  CIITA targeting sequence
gcuggcggaugagcugauug

SEQ ID NO: 48872 - RNA, 20 nt, Artificial Sequence
  CIITA targeting sequence
aguucagcuggcggaugagc

SEQ ID NO: 48873 - RNA, 20 nt, Artificial Sequence
  CIITA targeting sequence
aaaauauacugcaguuuggc

SEQ ID NO: 48874 - RNA, 20 nt, Artificial Sequence
  CIITA targeting sequence
augaaguggaagcauguguu

SEQ ID NO: 48875 - RNA, 20 nt, Artificial Sequence
  CIITA targeting sequence
uugaucaaaaauauacugca

SEQ ID NO: 48876 - RNA, 20 nt, Artificial Sequence
  CIITA targeting sequence
acuucauugaucaaaaauau

SEQ ID NO: 48877 - RNA, 20 nt, Artificial Sequence
  CIITA targeting sequence
caaaacaacaaaacacaugc

SEQ ID NO: 48878 - RNA, 20 nt, Artificial Sequence
  CIITA targeting sequence
agugucuucagagaagauua

SEQ ID NO: 48879 - RNA, 20 nt, Artificial Sequence
  CIITA targeting sequence
ucagagaagauuauuuccug

SEQ ID NO: 48880 - RNA, 20 nt, Artificial Sequence
  CIITA targeting sequence
gagaagauuauuuccugcuc

SEQ ID NO: 48881 - RNA, 20 nt, Artificial Sequence
  CIITA targeting sequence
gaagacacuugauaaaaauu

SEQ ID NO: 48882 - RNA, 20 nt, Artificial Sequence
  CIITA targeting sequence
cugaagacacuugauaaaaa

SEQ ID NO: 48883 - RNA, 20 nt, Artificial Sequence
  CIITA targeting sequence
ucucugaagacacuugauaa

SEQ ID NO: 48884 - RNA, 20 nt, Artificial Sequence
  CIITA targeting sequence
ugcucugucuucaaaaacug

SEQ ID NO: 48885 - RNA, 20 nt, Artificial Sequence
  CIITA targeting sequence
gucuucaaaaacuggaaagg

SEQ ID NO: 48886 - RNA, 20 nt, Artificial Sequence
  CIITA targeting sequence
ucaaaaacuggaaaggaagg

SEQ ID NO: 48887 - RNA, 20 nt, Artificial Sequence
  CIITA targeting sequence
aaaacuggaaaggaaggguc

SEQ ID NO: 48888 - RNA, 20 nt, Artificial Sequence
  CIITA targeting sequence
aguuuuugaagacagagcag

SEQ ID NO: 48889 - RNA, 20 nt, Artificial Sequence
  CIITA targeting sequence
uuuccaguuuuugaagacag

SEQ ID NO: 48890 - RNA, 20 nt, Artificial Sequence
  CIITA targeting sequence
aagaaaagacaguagcuggc

SEQ ID NO: 48891 - RNA, 20 nt, Artificial Sequence
  CIITA targeting sequence
cgcccguaaucccaacacuu

SEQ ID NO: 48892 - RNA, 20 nt, Artificial Sequence
  CIITA targeting sequence
caacacuuugggaggcugag

SEQ ID NO: 48893 - RNA, 20 nt, Artificial Sequence
  CIITA targeting sequence
caaaguguugggauuacggg

SEQ ID NO: 48894 - RNA, 20 nt, Artificial Sequence
  CIITA targeting sequence
gccucccaaaguguugggau

SEQ ID NO: 48895 - RNA, 20 nt, Artificial Sequence
  CIITA targeting sequence
gcccaccucagccucccaaa

SEQ ID NO: 48896 - RNA, 20 nt, Artificial Sequence
  CIITA targeting sequence
cuugagguugggaguucgag

SEQ ID NO: 48897 - RNA, 20 nt, Artificial Sequence
  CIITA targeting sequence
agugaucugcccaccucagc

SEQ ID NO: 48898 - RNA, 20 nt, Artificial Sequence
  CIITA targeting sequence
caaccucaagugaucugccc

SEQ ID NO: 48899 - RNA, 20 nt, Artificial Sequence
  CIITA targeting sequence
agaccagccugaccaacaug

SEQ ID NO: 48900 - RNA, 20 nt, Artificial Sequence
  CIITA targeting sequence
aacucccaaccucaagugau

SEQ ID NO: 48901 - RNA, 20 nt, Artificial Sequence
  CIITA targeting sequence
cgaacucccaaccucaagug

SEQ ID NO: 48902 - RNA, 20 nt, Artificial Sequence
  CIITA targeting sequence
aguaaauuuuaacauaugag

SEQ ID NO: 48903 - RNA, 20 nt, Artificial Sequence
  CIITA targeting sequence
uauguuaaaauuuacuggau

SEQ ID NO: 48904 - RNA, 20 nt, Artificial Sequence
  CIITA targeting sequence
uucagcuuaaaauuuuacac

SEQ ID NO: 48905 - RNA, 20 nt, Artificial Sequence
  CIITA targeting sequence
gcuuaaaauuuuacacaguu

SEQ ID NO: 48906 - RNA, 20 nt, Artificial Sequence
  CIITA targeting sequence
cuuuugauuucuuguguuuu

SEQ ID NO: 48907 - RNA, 20 nt, Artificial Sequence
  CIITA targeting sequence
aaagggaaacuguguaaaau

SEQ ID NO: 48908 - RNA, 20 nt, Artificial Sequence
  CIITA targeting sequence
uguguuuugucauguguaua

SEQ ID NO: 48909 - RNA, 20 nt, Artificial Sequence
  CIITA targeting sequence
uguguauaauuucuagcugu

SEQ ID NO: 48910 - RNA, 20 nt, Artificial Sequence
  CIITA targeting sequence
agcuguguuucucuuauuga

SEQ ID NO: 48911 - RNA, 20 nt, Artificial Sequence
  CIITA targeting sequence
cuuauugauuuuucuccugc

SEQ ID NO: 48912 - RNA, 20 nt, Artificial Sequence
  CIITA targeting sequence
uauugauuuuucuccugcuu

SEQ ID NO: 48913 - RNA, 20 nt, Artificial Sequence
  CIITA targeting sequence
auaagagaaacacagcuaga

SEQ ID NO: 48914 - RNA, 20 nt, Artificial Sequence
  CIITA targeting sequence
ccugcuuuuggauuccuucc

SEQ ID NO: 48915 - RNA, 20 nt, Artificial Sequence
  CIITA targeting sequence
ugcuuuuggauuccuucccc

SEQ ID NO: 48916 - RNA, 20 nt, Artificial Sequence
  CIITA targeting sequence
aaaagcaggagaaaaaucaa

SEQ ID NO: 48917 - RNA, 20 nt, Artificial Sequence
  CIITA targeting sequence
uucccccauuuuuugcaugc

SEQ ID NO: 48918 - RNA, 20 nt, Artificial Sequence
  CIITA targeting sequence
cccauuuuuugcaugccugg

SEQ ID NO: 48919 - RNA, 20 nt, Artificial Sequence
  CIITA targeting sequence
uuuuugauugguugacaguu

SEQ ID NO: 48920 - RNA, 20 nt, Artificial Sequence
  CIITA targeting sequence
aaaaugaccaggcaugcaaa

SEQ ID NO: 48921 - RNA, 20 nt, Artificial Sequence
  CIITA targeting sequence
accaaucaaaaaugaccagg

SEQ ID NO: 48922 - RNA, 20 nt, Artificial Sequence
  CIITA targeting sequence
caguuggaugcuggauucuu

SEQ ID NO: 48923 - RNA, 20 nt, Artificial Sequence
  CIITA targeting sequence
aacugugaaaaaccacagua

SEQ ID NO: 48924 - RNA, 20 nt, Artificial Sequence
  CIITA targeting sequence
agcauccaacugugaaaaac

SEQ ID NO: 48925 - RNA, 20 nt, Artificial Sequence
  CIITA targeting sequence
uccuguaaauauuuuugggc

SEQ ID NO: 48926 - RNA, 20 nt, Artificial Sequence
  CIITA targeting sequence
uguaaauauuuuugggcuga

SEQ ID NO: 48927 - RNA, 20 nt, Artificial Sequence
  CIITA targeting sequence
gcccaaaaauauuuacagga

SEQ ID NO: 48928 - RNA, 20 nt, Artificial Sequence
  CIITA targeting sequence
guuaauuggaguugguuuga

SEQ ID NO: 48929 - RNA, 20 nt, Artificial Sequence
  CIITA targeting sequence
aauuaacugaaccaucagcc

SEQ ID NO: 48930 - RNA, 20 nt, Artificial Sequence
  CIITA targeting sequence
aaccaacuccaauuaacuga

SEQ ID NO: 48931 - RNA, 20 nt, Artificial Sequence
  CIITA targeting sequence
uuuuuugaggcuugcuuuua

SEQ ID NO: 48932 - RNA, 20 nt, Artificial Sequence
  CIITA targeting sequence
aaaaaggaucaaaccaacuc

SEQ ID NO: 48933 - RNA, 20 nt, Artificial Sequence
  CIITA targeting sequence
gugagagcugguccagacag

SEQ ID NO: 48934 - RNA, 20 nt, Artificial Sequence
  CIITA targeting sequence
cagagcuuaaaagcaagccu

SEQ ID NO: 48935 - RNA, 20 nt, Artificial Sequence
  CIITA targeting sequence
cacagagcuuaaaagcaagc

SEQ ID NO: 48936 - RNA, 20 nt, Artificial Sequence
  CIITA targeting sequence
agacagccuucaguuuaggg

SEQ ID NO: 48937 - RNA, 20 nt, Artificial Sequence
  CIITA targeting sequence
ggaccagcucucacagagcu

SEQ ID NO: 48938 - RNA, 20 nt, Artificial Sequence
  CIITA targeting sequence
guuuagggcuaacuucgccc

SEQ ID NO: 48939 - RNA, 20 nt, Artificial Sequence
  CIITA targeting sequence
cccuauuacugagacauuac

SEQ ID NO: 48940 - RNA, 20 nt, Artificial Sequence
  CIITA targeting sequence
uucaucuguuaauggaaauu

SEQ ID NO: 48941 - RNA, 20 nt, Artificial Sequence
  CIITA targeting sequence
ucuguuaauggaaauuuggg

SEQ ID NO: 48942 - RNA, 20 nt, Artificial Sequence
  CIITA targeting sequence
guuaauggaaauuuggguug

SEQ ID NO: 48943 - RNA, 20 nt, Artificial Sequence
  CIITA targeting sequence
auuaacagaugaaugaauaa

SEQ ID NO: 48944 - RNA, 20 nt, Artificial Sequence
  CIITA targeting sequence
aguuuuggacuauuacaaac

SEQ ID NO: 48945 - RNA, 20 nt, Artificial Sequence
  CIITA targeting sequence
aaaacuggaaacaacccaaa

SEQ ID NO: 48946 - RNA, 20 nt, Artificial Sequence
  CIITA targeting sequence
cagcagcuuuguuuguaaua

SEQ ID NO: 48947 - RNA, 20 nt, Artificial Sequence
  CIITA targeting sequence
ccauucuaauagguuugcag

SEQ ID NO: 48948 - RNA, 20 nt, Artificial Sequence
  CIITA targeting sequence
aauagguuugcagugguauc

SEQ ID NO: 48949 - RNA, 20 nt, Artificial Sequence
  CIITA targeting sequence
uaugaucuuaauuugcauau

SEQ ID NO: 48950 - RNA, 20 nt, Artificial Sequence
  CIITA targeting sequence
uaagauaccacugcaaaccu

SEQ ID NO: 48951 - RNA, 20 nt, Artificial Sequence
  CIITA targeting sequence
uaauuugcauaucccuaaug

SEQ ID NO: 48952 - RNA, 20 nt, Artificial Sequence
  CIITA targeting sequence
cuaaugacauugaacaucuu

SEQ ID NO: 48953 - RNA, 20 nt, Artificial Sequence
  CIITA targeting sequence
uuagggauaugcaaauuaag

SEQ ID NO: 48954 - RNA, 20 nt, Artificial Sequence
  CIITA targeting sequence
augucauuagggauaugcaa

SEQ ID NO: 48955 - RNA, 20 nt, Artificial Sequence
  CIITA targeting sequence
uuucauguguuucuuuugcc

SEQ ID NO: 48956 - RNA, 20 nt, Artificial Sequence
  CIITA targeting sequence
cuguauuuuuucucucccau

SEQ ID NO: 48957 - RNA, 20 nt, Artificial Sequence
  CIITA targeting sequence
guauuuuuucucucccauuc

SEQ ID NO: 48958 - RNA, 20 nt, Artificial Sequence
  CIITA targeting sequence
cucccauucuggacugcuag

SEQ ID NO: 48959 - RNA, 20 nt, Artificial Sequence
  CIITA targeting sequence
cccauucuggacugcuaggc

SEQ ID NO: 48960 - RNA, 20 nt, Artificial Sequence
  CIITA targeting sequence
cauucuggacugcuaggccu

SEQ ID NO: 48961 - RNA, 20 nt, Artificial Sequence
  CIITA targeting sequence
ggacugcuaggccuuggaag

SEQ ID NO: 48962 - RNA, 20 nt, Artificial Sequence
  CIITA targeting sequence
agaaugggagagaaaaaaua

SEQ ID NO: 48963 - RNA, 20 nt, Artificial Sequence
  CIITA targeting sequence
aaggccuagcaguccagaau

SEQ ID NO: 48964 - RNA, 20 nt, Artificial Sequence
  CIITA targeting sequence
gccuuccaaggccuagcagu

SEQ ID NO: 48965 - RNA, 20 nt, Artificial Sequence
  CIITA targeting sequence
cuguugcacuucucgcuaca

SEQ ID NO: 48966 - RNA, 20 nt, Artificial Sequence
  CIITA targeting sequence
gccugccccaccgcauuacc

SEQ ID NO: 48967 - RNA, 20 nt, Artificial Sequence
  CIITA targeting sequence
acccucagccugccccaccg

SEQ ID NO: 48968 - RNA, 20 nt, Artificial Sequence
  CIITA targeting sequence
gccugagcaaucaggagagg

SEQ ID NO: 48969 - RNA, 20 nt, Artificial Sequence
  CIITA targeting sequence
ggcggauguaguacccucua

SEQ ID NO: 48970 - RNA, 20 nt, Artificial Sequence
  CIITA targeting sequence
ggagaggccucuuggaggcu

SEQ ID NO: 48971 - RNA, 20 nt, Artificial Sequence
  CIITA targeting sequence
gauggaaguuuuuaaaagaa

SEQ ID NO: 48972 - RNA, 20 nt, Artificial Sequence
  CIITA targeting sequence
gaccacaucacuguccuacu

SEQ ID NO: 48973 - RNA, 20 nt, Artificial Sequence
  CIITA targeting sequence
aucugaccacaucacugucc

SEQ ID NO: 48974 - RNA, 20 nt, Artificial Sequence
  CIITA targeting sequence
uuuaaaaacuuccaucugac

SEQ ID NO: 48975 - RNA, 20 nt, Artificial Sequence
  CIITA targeting sequence
gguagccaacguuucuuuua

SEQ ID NO: 48976 - RNA, 20 nt, Artificial Sequence
  CIITA targeting sequence
gucugguagccaacguuucu

SEQ ID NO: 48977 - RNA, 20 nt, Artificial Sequence
  CIITA targeting sequence
acuuucugucugguagccaa

SEQ ID NO: 48978 - RNA, 20 nt, Artificial Sequence
  CIITA targeting sequence
ucuacuuucugucugguagc

SEQ ID NO: 48979 - RNA, 20 nt, Artificial Sequence
  CIITA targeting sequence
ccacccccagucaucuacuu

SEQ ID NO: 48980 - RNA, 20 nt, Artificial Sequence
  CIITA targeting sequence
uccccacccccagucaucua

SEQ ID NO: 48981 - RNA, 20 nt, Artificial Sequence
  CIITA targeting sequence
ugcaacucauccccaccccc

SEQ ID NO: 48982 - RNA, 20 nt, Artificial Sequence
  CIITA targeting sequence
cuccugcaacucauccccac

SEQ ID NO: 48983 - RNA, 20 nt, Artificial Sequence
  CIITA targeting sequence
guguucccuccugcaacuca

SEQ ID NO: 48984 - RNA, 20 nt, Artificial Sequence
  CIITA targeting sequence
cgguguucccuccugcaacu

SEQ ID NO: 48985 - RNA, 20 nt, Artificial Sequence
  CIITA targeting sequence
cucgguguucccuccugcaa

SEQ ID NO: 48986 - RNA, 20 nt, Artificial Sequence
  CIITA targeting sequence
uagcaagucucucgguguuc

SEQ ID NO: 48987 - RNA, 20 nt, Artificial Sequence
  CIITA targeting sequence
uccaggcgagauaaugugga

SEQ ID NO: 48988 - RNA, 20 nt, Artificial Sequence
  CIITA targeting sequence
aggcgagauaauguggauug

SEQ ID NO: 48989 - RNA, 20 nt, Artificial Sequence
  CIITA targeting sequence
ccuggaugacugcaacagcu

SEQ ID NO: 48990 - RNA, 20 nt, Artificial Sequence
  CIITA targeting sequence
cgccuggaugacugcaacag

SEQ ID NO: 48991 - RNA, 20 nt, Artificial Sequence
  CIITA targeting sequence
acauuaucucgccuggauga

SEQ ID NO: 48992 - RNA, 20 nt, Artificial Sequence
  CIITA targeting sequence
aauccacauuaucucgccug

SEQ ID NO: 48993 - RNA, 20 nt, Artificial Sequence
  CIITA targeting sequence
ccagccagcagccuaaucca

SEQ ID NO: 48994 - RNA, 20 nt, Artificial Sequence
  CIITA targeting sequence
acuccccagccagcagccua

SEQ ID NO: 48995 - RNA, 20 nt, Artificial Sequence
  CIITA targeting sequence
ucuacuccccagccagcagc

SEQ ID NO: 48996 - RNA, 20 nt, Artificial Sequence
  CIITA targeting sequence
aguuuccucuacuccccagc

SEQ ID NO: 48997 - RNA, 20 nt, Artificial Sequence
  CIITA targeting sequence
uuccaguuuccucuacuccc

SEQ ID NO: 48998 - RNA, 20 nt, Artificial Sequence
  CIITA targeting sequence
caaguccuuccaguuuccuc

SEQ ID NO: 48999 - RNA, 20 nt, Artificial Sequence
  CIITA targeting sequence
gcgcuagagccaggacgugc

SEQ ID NO: 49000 - RNA, 20 nt, Artificial Sequence
  CIITA targeting sequence
agcgcugaaauaaucacaag

SEQ ID NO: 49001 - RNA, 20 nt, Artificial Sequence
  CIITA targeting sequence
uggcucuagcgcugaaauaa

SEQ ID NO: 49002 - RNA, 20 nt, Artificial Sequence
  CIITA targeting sequence
cuuuuccagauccuuacccc

SEQ ID NO: 49003 - RNA, 20 nt, Artificial Sequence
  CIITA targeting sequence
agauccuuaccccccaaauc

SEQ ID NO: 49004 - RNA, 20 nt, Artificial Sequence
  CIITA targeting sequence
ggaaaagugaggcugaaggu

SEQ ID NO: 49005 - RNA, 20 nt, Artificial Sequence
  CIITA targeting sequence
uuaccccccaaaucaggucc

SEQ ID NO: 49006 - RNA, 20 nt, Artificial Sequence
  CIITA targeting sequence
ggucccaagugaccuggucu

SEQ ID NO: 49007 - RNA, 20 nt, Artificial Sequence
  CIITA targeting sequence
caagugaccuggucucuuuc

SEQ ID NO: 49008 - RNA, 20 nt, Artificial Sequence
  CIITA targeting sequence
cuugggaccugauuuggggg

SEQ ID NO: 49009 - RNA, 20 nt, Artificial Sequence
  CIITA targeting sequence
cuuucucauagauuuuuucc

SEQ ID NO: 49010 - RNA, 20 nt, Artificial Sequence
  CIITA targeting sequence
uucucauagauuuuuuccuc

SEQ ID NO: 49011 - RNA, 20 nt, Artificial Sequence
  CIITA targeting sequence
cauagauuuuuuccucauag

SEQ ID NO: 49012 - RNA, 20 nt, Artificial Sequence
  CIITA targeting sequence
uagauuuuuuccucauaguc

SEQ ID NO: 49013 - RNA, 20 nt, Artificial Sequence
  CIITA targeting sequence
augagaaagagaccagguca

SEQ ID NO: 49014 - RNA, 20 nt, Artificial Sequence
  CIITA targeting sequence
ucauagucaauuuuaacaua

SEQ ID NO: 49015 - RNA, 20 nt, Artificial Sequence
  CIITA targeting sequence
uagucaauuuuaacauaaaa

SEQ ID NO: 49016 - RNA, 20 nt, Artificial Sequence
  CIITA targeting sequence
auuuuaacauaaaagccacg

SEQ ID NO: 49017 - RNA, 20 nt, Artificial Sequence
  CIITA targeting sequence
uaaaaaccaaaugugagcuc

SEQ ID NO: 49018 - RNA, 20 nt, Artificial Sequence
  CIITA targeting sequence
cauuugguuuuuaugaacgu

SEQ ID NO: 49019 - RNA, 20 nt, Artificial Sequence
  CIITA targeting sequence
ggccuuccaguaaucauaau

SEQ ID NO: 49020 - RNA, 20 nt, Artificial Sequence
  CIITA targeting sequence
aguaaucauaauagauuaga

SEQ ID NO: 49021 - RNA, 20 nt, Artificial Sequence
  CIITA targeting sequence
uaauagauuagaugcugcac

SEQ ID NO: 49022 - RNA, 20 nt, Artificial Sequence
  CIITA targeting sequence
auuaugauuacuggaaggcc

SEQ ID NO: 49023 - RNA, 20 nt, Artificial Sequence
  CIITA targeting sequence
aaucuauuaugauuacugga

SEQ ID NO: 49024 - RNA, 20 nt, Artificial Sequence
  CIITA targeting sequence
gugcagcaucuaaucuauua

SEQ ID NO: 49025 - RNA, 20 nt, Artificial Sequence
  CIITA targeting sequence
uuucggugcagcaucuaauc

SEQ ID NO: 49026 - RNA, 20 nt, Artificial Sequence
  CIITA targeting sequence
cacaguggaaaggguugacc

SEQ ID NO: 49027 - RNA, 20 nt, Artificial Sequence
  CIITA targeting sequence
acugugggauauucauuucg

SEQ ID NO: 49028 - RNA, 20 nt, Artificial Sequence
  CIITA targeting sequence
acccuuuccacugugggaua

SEQ ID NO: 49029 - RNA, 20 nt, Artificial Sequence
  CIITA targeting sequence
gccaaccggucaacccuuuc

SEQ ID NO: 49030 - RNA, 20 nt, Artificial Sequence
  CIITA targeting sequence
caacaagcgccuuccgccaa

SEQ ID NO: 49031 - RNA, 20 nt, Artificial Sequence
  CIITA targeting sequence
guugggccacauaaugaauu

SEQ ID NO: 49032 - RNA, 20 nt, Artificial Sequence
  CIITA targeting sequence
uuauguggcccaacugaauc

SEQ ID NO: 49033 - RNA, 20 nt, Artificial Sequence
  CIITA targeting sequence
gguuuguuucuguaauagaa

SEQ ID NO: 49034 - RNA, 20 nt, Artificial Sequence
  CIITA targeting sequence
guaauagaaaaugcagccuu

SEQ ID NO: 49035 - RNA, 20 nt, Artificial Sequence
  CIITA targeting sequence
auuacagaaacaaaccagaa

SEQ ID NO: 49036 - RNA, 20 nt, Artificial Sequence
  CIITA targeting sequence
cucuucuaucaaguccgcug

SEQ ID NO: 49037 - RNA, 20 nt, Artificial Sequence
  CIITA targeting sequence
ucuaucaaguccgcugaguc

SEQ ID NO: 49038 - RNA, 20 nt, Artificial Sequence
  CIITA targeting sequence
aucaaguccgcugaguccug

SEQ ID NO: 49039 - RNA, 20 nt, Artificial Sequence
  CIITA targeting sequence
aguccgcugaguccugggcc

SEQ ID NO: 49040 - RNA, 20 nt, Artificial Sequence
  CIITA targeting sequence
gcugaguccugggccagagg

SEQ ID NO: 49041 - RNA, 20 nt, Artificial Sequence
  CIITA targeting sequence
gcggacuugauagaagagcg

SEQ ID NO: 49042 - RNA, 20 nt, Artificial Sequence
  CIITA targeting sequence
ugggccagagguggagggau

SEQ ID NO: 49043 - RNA, 20 nt, Artificial Sequence
  CIITA targeting sequence
ggcccaggacucagcggacu

SEQ ID NO: 49044 - RNA, 20 nt, Artificial Sequence
  CIITA targeting sequence
accucuggcccaggacucag

SEQ ID NO: 49045 - RNA, 20 nt, Artificial Sequence
  CIITA targeting sequence
cuccaccucuggcccaggac

SEQ ID NO: 49046 - RNA, 20 nt, Artificial Sequence
  CIITA targeting sequence
cccccaucccuccaccucug

SEQ ID NO: 49047 - RNA, 20 nt, Artificial Sequence
  CIITA targeting sequence
ugaagguuccccaguucagu

SEQ ID NO: 49048 - RNA, 20 nt, Artificial Sequence
  CIITA targeting sequence
agauacaaaagcuguaaaac

SEQ ID NO: 49049 - RNA, 20 nt, Artificial Sequence
  CIITA targeting sequence
ccaguucagugaccaaccuu

SEQ ID NO: 49050 - RNA, 20 nt, Artificial Sequence
  CIITA targeting sequence
gugaccaaccuucuacuccu

SEQ ID NO: 49051 - RNA, 20 nt, Artificial Sequence
  CIITA targeting sequence
cugaacuggggaaccuucaa

SEQ ID NO: 49052 - RNA, 20 nt, Artificial Sequence
  CIITA targeting sequence
acuccugccacuccauuugu

SEQ ID NO: 49053 - RNA, 20 nt, Artificial Sequence
  CIITA targeting sequence
ugccacuccauuugucauug

SEQ ID NO: 49054 - RNA, 20 nt, Artificial Sequence
  CIITA targeting sequence
auuugucauuguuuacccag

SEQ ID NO: 49055 - RNA, 20 nt, Artificial Sequence
  CIITA targeting sequence
uuguuuacccaggaagaagg

SEQ ID NO: 49056 - RNA, 20 nt, Artificial Sequence
  CIITA targeting sequence
uggguaaacaaugacaaaug

SEQ ID NO: 49057 - RNA, 20 nt, Artificial Sequence
  CIITA targeting sequence
uccuggguaaacaaugacaa

SEQ ID NO: 49058 - RNA, 20 nt, Artificial Sequence
  CIITA targeting sequence
uucuuccuggguaaacaaug

SEQ ID NO: 49059 - RNA, 20 nt, Artificial Sequence
  CIITA targeting sequence
ugggcucuuuguguuuugug

SEQ ID NO: 49060 - RNA, 20 nt, Artificial Sequence
  CIITA targeting sequence
uuguguuuuguguuuuguuu

SEQ ID NO: 49061 - RNA, 20 nt, Artificial Sequence
  CIITA targeting sequence
gcaaaacaaaacacaaaaca

SEQ ID NO: 49062 - RNA, 20 nt, Artificial Sequence
  CIITA targeting sequence
cagcaaaacaaaacacaaaa

SEQ ID NO: 49063 - RNA, 20 nt, Artificial Sequence
  CIITA targeting sequence
auuaacuucucagcaaaaca

SEQ ID NO: 49064 - RNA, 20 nt, Artificial Sequence
  CIITA targeting sequence
auguuccauuaacuucucag

SEQ ID NO: 49065 - RNA, 20 nt, Artificial Sequence
  CIITA targeting sequence
uccauguuccauuaacuucu

SEQ ID NO: 49066 - RNA, 20 nt, Artificial Sequence
  CIITA targeting sequence
cucauccauguuccauuaac

SEQ ID NO: 49067 - RNA, 20 nt, Artificial Sequence
  CIITA targeting sequence
auaucgcucauccauguucc

SEQ ID NO: 49068 - RNA, 20 nt, Artificial Sequence
  CIITA targeting sequence
accuuuuccauaucgcucau

SEQ ID NO: 49069 - RNA, 20 nt, Artificial Sequence
  CIITA targeting sequence
cuuuagccuauuaccuuuca

SEQ ID NO: 49070 - RNA, 20 nt, Artificial Sequence
  CIITA targeting sequence
gcauggcaaaagcuucccuu

SEQ ID NO: 49071 - RNA, 20 nt, Artificial Sequence
  CIITA targeting sequence
ccgcauggcaaaagcuuccc

SEQ ID NO: 49072 - RNA, 20 nt, Artificial Sequence
  CIITA targeting sequence
guuuggaucuuggcugacac

SEQ ID NO: 49073 - RNA, 20 nt, Artificial Sequence
  CIITA targeting sequence
aaacugacguugugcaaguu

SEQ ID NO: 49074 - RNA, 20 nt, Artificial Sequence
  CIITA targeting sequence
uggcugacacauaaccagaa

SEQ ID NO: 49075 - RNA, 20 nt, Artificial Sequence
  CIITA targeting sequence
gccaagauccaaacugacgu

SEQ ID NO: 49076 - RNA, 20 nt, Artificial Sequence
  CIITA targeting sequence
gguuaugugucagccaagau

SEQ ID NO: 49077 - RNA, 20 nt, Artificial Sequence
  CIITA targeting sequence
aauucugguuaugugucagc

SEQ ID NO: 49078 - RNA, 20 nt, Artificial Sequence
  CIITA targeting sequence
aauguacuucuaauucuggu

SEQ ID NO: 49079 - RNA, 20 nt, Artificial Sequence
  CIITA targeting sequence
gcccaacaucugguuagcuu

SEQ ID NO: 49080 - RNA, 20 nt, Artificial Sequence
  CIITA targeting sequence
gguuagcuuucgaaaucuuu

SEQ ID NO: 49081 - RNA, 20 nt, Artificial Sequence
  CIITA targeting sequence
aaaucuuuggucuauagucu

SEQ ID NO: 49082 - RNA, 20 nt, Artificial Sequence
  CIITA targeting sequence
aaagcuaaccagauguuggg

SEQ ID NO: 49083 - RNA, 20 nt, Artificial Sequence
  CIITA targeting sequence
uuggucuauagucuuccaaa

SEQ ID NO: 49084 - RNA, 20 nt, Artificial Sequence
  CIITA targeting sequence
auagucuuccaaagcuggua

SEQ ID NO: 49085 - RNA, 20 nt, Artificial Sequence
  CIITA targeting sequence
uccaaagcugguaauacuug

SEQ ID NO: 49086 - RNA, 20 nt, Artificial Sequence
  CIITA targeting sequence
aaagcugguaauacuugugu

SEQ ID NO: 49087 - RNA, 20 nt, Artificial Sequence
  CIITA targeting sequence
cacaaguauuaccagcuuug

SEQ ID NO: 49088 - RNA, 20 nt, Artificial Sequence
  CIITA targeting sequence
uuggcugcagucacacaagu

SEQ ID NO: 49089 - RNA, 20 nt, Artificial Sequence
  CIITA targeting sequence
ccuuggcugcagucacacaa

SEQ ID NO: 49090 - RNA, 20 nt, Artificial Sequence
  CIITA targeting sequence
acagacguuuuuaaaaaguu

SEQ ID NO: 49091 - RNA, 20 nt, Artificial Sequence
  CIITA targeting sequence
guugaccacacaaagucucc

SEQ ID NO: 49092 - RNA, 20 nt, Artificial Sequence
  CIITA targeting sequence
aacuuuuuaaaaacgucugu

SEQ ID NO: 49093 - RNA, 20 nt, Artificial Sequence
  CIITA targeting sequence
cccuuaguaguagcccccau

SEQ ID NO: 49094 - RNA, 20 nt, Artificial Sequence
  CIITA targeting sequence
ucccccuuaguaguagcccc

SEQ ID NO: 49095 - RNA, 20 nt, Artificial Sequence
  CIITA targeting sequence
agauaucagaacugagaggg

SEQ ID NO: 49096 - RNA, 20 nt, Artificial Sequence
  CIITA targeting sequence
ggauucuucccccuuaguag

SEQ ID NO: 49097 - RNA, 20 nt, Artificial Sequence
  CIITA targeting sequence
gaacugagagggaagcuuag

SEQ ID NO: 49098 - RNA, 20 nt, Artificial Sequence
  CIITA targeting sequence
gauaucuggauucuuccccc

SEQ ID NO: 49099 - RNA, 20 nt, Artificial Sequence
  CIITA targeting sequence
guucugauaucuggauucuu

SEQ ID NO: 49100 - RNA, 20 nt, Artificial Sequence
  CIITA targeting sequence
caguucugauaucuggauuc

SEQ ID NO: 49101 - RNA, 20 nt, Artificial Sequence
  CIITA targeting sequence
cucucaguucugauaucugg

SEQ ID NO: 49102 - RNA, 20 nt, Artificial Sequence
  CIITA targeting sequence
uacuaagcuucccucucagu

SEQ ID NO: 49103 - RNA, 20 nt, Artificial Sequence
  CIITA targeting sequence
acggguggacaggggacacc

SEQ ID NO: 49104 - RNA, 20 nt, Artificial Sequence
  CIITA targeting sequence
acccguggacagggguggag

SEQ ID NO: 49105 - RNA, 20 nt, Artificial Sequence
  CIITA targeting sequence
ccuguccacccguggacagg

SEQ ID NO: 49106 - RNA, 20 nt, Artificial Sequence
  CIITA targeting sequence
gagucggugggcagcucagg

SEQ ID NO: 49107 - RNA, 20 nt, Artificial Sequence
  CIITA targeting sequence
gaacggguguccccugucca

SEQ ID NO: 49108 - RNA, 20 nt, Artificial Sequence
  CIITA targeting sequence
gugggcagcucaggcucuga

SEQ ID NO: 49109 - RNA, 20 nt, Artificial Sequence
  CIITA targeting sequence
ggcucugaccccuaaggcag

SEQ ID NO: 49110 - RNA, 20 nt, Artificial Sequence
  CIITA targeting sequence
gaccccuaaggcagggcugu

SEQ ID NO: 49111 - RNA, 20 nt, Artificial Sequence
  CIITA targeting sequence
gagccugagcugcccaccga

SEQ ID NO: 49112 - RNA, 20 nt, Artificial Sequence
  CIITA targeting sequence
ggcuuccagcagaccacaug

SEQ ID NO: 49113 - RNA, 20 nt, Artificial Sequence
  CIITA targeting sequence
uucuggcuuccagcagacca

SEQ ID NO: 49114 - RNA, 20 nt, Artificial Sequence
  CIITA targeting sequence
cgugaagugcagcaggguuu

SEQ ID NO: 49115 - RNA, 20 nt, Artificial Sequence
  CIITA targeting sequence
cgggagcacuagcucauucu

SEQ ID NO: 49116 - RNA, 20 nt, Artificial Sequence
  CIITA targeting sequence
uuggaauuugucugucacaa

SEQ ID NO: 49117 - RNA, 20 nt, Artificial Sequence
  CIITA targeting sequence
aaagaaacccugcugcacuu

SEQ ID NO: 49118 - RNA, 20 nt, Artificial Sequence
  CIITA targeting sequence
gucacaaagcacuuaagagu

SEQ ID NO: 49119 - RNA, 20 nt, Artificial Sequence
  CIITA targeting sequence
caaagcacuuaagaguugaa

SEQ ID NO: 49120 - RNA, 20 nt, Artificial Sequence
  CIITA targeting sequence
uaagugcuuugugacagaca

SEQ ID NO: 49121 - RNA, 20 nt, Artificial Sequence
  CIITA targeting sequence
acucuuaagugcuuugugac

SEQ ID NO: 49122 - RNA, 20 nt, Artificial Sequence
  CIITA targeting sequence
uauuugcuucaacucuuaag

SEQ ID NO: 49123 - RNA, 20 nt, Artificial Sequence
  CIITA targeting sequence
acaguguuuauuucugucag

SEQ ID NO: 49124 - RNA, 20 nt, Artificial Sequence
  CIITA targeting sequence
augucacccuguaacagggg

SEQ ID NO: 49125 - RNA, 20 nt, Artificial Sequence
  CIITA targeting sequence
gaaccaucagccaccagguu

SEQ ID NO: 49126 - RNA, 20 nt, Artificial Sequence
  CIITA targeting sequence
gaguggcuaaggucaauguc

SEQ ID NO: 49127 - RNA, 20 nt, Artificial Sequence
  CIITA targeting sequence
gccaccagguuguuucaggc

SEQ ID NO: 49128 - RNA, 20 nt, Artificial Sequence
  CIITA targeting sequence
ggcaggaggcuuaaaccuaa

SEQ ID NO: 49129 - RNA, 20 nt, Artificial Sequence
  CIITA targeting sequence
ugccugaaacaaccuggugg

SEQ ID NO: 49130 - RNA, 20 nt, Artificial Sequence
  CIITA targeting sequence
aauguucgccacaaauuaaa

SEQ ID NO: 49131 - RNA, 20 nt, Artificial Sequence
  CIITA targeting sequence
ccacaaauuaaaugccaucc

SEQ ID NO: 49132 - RNA, 20 nt, Artificial Sequence
  CIITA targeting sequence
ccugaaagugguuugagcug

SEQ ID NO: 49133 - RNA, 20 nt, Artificial Sequence
  CIITA targeting sequence
ggugaucccgaaggugggug

SEQ ID NO: 49134 - RNA, 20 nt, Artificial Sequence
  CIITA targeting sequence
aaccacuuucaggugauccc

SEQ ID NO: 49135 - RNA, 20 nt, Artificial Sequence
  CIITA targeting sequence
cugacuugcucugugaccuu

SEQ ID NO: 49136 - RNA, 20 nt, Artificial Sequence
  CIITA targeting sequence
gacuugcucugugaccuugg

SEQ ID NO: 49137 - RNA, 20 nt, Artificial Sequence
  CIITA targeting sequence
gagacacagcucaaaccacu

SEQ ID NO: 49138 - RNA, 20 nt, Artificial Sequence
  CIITA targeting sequence
gugaccuuggggaaacaaca

SEQ ID NO: 49139 - RNA, 20 nt, Artificial Sequence
  CIITA targeting sequence
cagagcaagucagagacaca

SEQ ID NO: 49140 - RNA, 20 nt, Artificial Sequence
  CIITA targeting sequence
ccaaggucacagagcaaguc

SEQ ID NO: 49141 - RNA, 20 nt, Artificial Sequence
  CIITA targeting sequence
gggccuuaacuuccucauga

SEQ ID NO: 49142 - RNA, 20 nt, Artificial Sequence
  CIITA targeting sequence
uccugucaagaaaagagcuu

SEQ ID NO: 49143 - RNA, 20 nt, Artificial Sequence
  CIITA targeting sequence
ugucaagaaaagagcuugcc

SEQ ID NO: 49144 - RNA, 20 nt, Artificial Sequence
  CIITA targeting sequence
agaaaagagcuugccccaga

SEQ ID NO: 49145 - RNA, 20 nt, Artificial Sequence
  CIITA targeting sequence
ugacaggaagaaaagcgucc

SEQ ID NO: 49146 - RNA, 20 nt, Artificial Sequence
  CIITA targeting sequence
uuucuugacaggaagaaaag

SEQ ID NO: 49147 - RNA, 20 nt, Artificial Sequence
  CIITA targeting sequence
ggggcaagcucuuuucuuga

SEQ ID NO: 49148 - RNA, 20 nt, Artificial Sequence
  CIITA targeting sequence
ucacuguccacaaauucuaa

SEQ ID NO: 49149 - RNA, 20 nt, Artificial Sequence
  CIITA targeting sequence
cuguccacaaauucuaagga

SEQ ID NO: 49150 - RNA, 20 nt, Artificial Sequence
  CIITA targeting sequence
acaaauucuaaggagacgga

SEQ ID NO: 49151 - RNA, 20 nt, Artificial Sequence
  CIITA targeting sequence
aaggagacggaggggcaaug

SEQ ID NO: 49152 - RNA, 20 nt, Artificial Sequence
  CIITA targeting sequence
uuagaauuuguggacaguga

SEQ ID NO: 49153 - RNA, 20 nt, Artificial Sequence
  CIITA targeting sequence
ccuuagaauuuguggacagu

SEQ ID NO: 49154 - RNA, 20 nt, Artificial Sequence
  CIITA targeting sequence
gucuccuuagaauuugugga

SEQ ID NO: 49155 - RNA, 20 nt, Artificial Sequence
  CIITA targeting sequence
uucuggcauuuguuuuuucc

SEQ ID NO: 49156 - RNA, 20 nt, Artificial Sequence
  CIITA targeting sequence
guugacauucuucuugccau

SEQ ID NO: 49157 - RNA, 20 nt, Artificial Sequence
  CIITA targeting sequence
acugaaucuuucuggcauuu

SEQ ID NO: 49158 - RNA, 20 nt, Artificial Sequence
  CIITA targeting sequence
ucuugccauucaauaagcca

SEQ ID NO: 49159 - RNA, 20 nt, Artificial Sequence
  CIITA targeting sequence
ugccauucaauaagccagaa

SEQ ID NO: 49160 - RNA, 20 nt, Artificial Sequence
  CIITA targeting sequence
auaagccagaauccuucaga

SEQ ID NO: 49161 - RNA, 20 nt, Artificial Sequence
  CIITA targeting sequence
ggcuuauugaauggcaagaa

SEQ ID NO: 49162 - RNA, 20 nt, Artificial Sequence
  CIITA targeting sequence
uucagaguuacacauuuagc

SEQ ID NO: 49163 - RNA, 20 nt, Artificial Sequence
  CIITA targeting sequence
gaguuacacauuuagcauua

SEQ ID NO: 49164 - RNA, 20 nt, Artificial Sequence
  CIITA targeting sequence
gaaggauucuggcuuauuga

SEQ ID NO: 49165 - RNA, 20 nt, Artificial Sequence
  CIITA targeting sequence
agucuuuaggccgucccuca

SEQ ID NO: 49166 - RNA, 20 nt, Artificial Sequence
  CIITA targeting sequence
uuaggccgucccucacccag

SEQ ID NO: 49167 - RNA, 20 nt, Artificial Sequence
  CIITA targeting sequence
cucacccaggucaucuccuu

SEQ ID NO: 49168 - RNA, 20 nt, Artificial Sequence
  CIITA targeting sequence
cccaggucaucuccuuggua

SEQ ID NO: 49169 - RNA, 20 nt, Artificial Sequence
  CIITA targeting sequence
ucuccuugguaugacuuagc

SEQ ID NO: 49170 - RNA, 20 nt, Artificial Sequence
  CIITA targeting sequence
ccuugguaugacuuagccuc

SEQ ID NO: 49171 - RNA, 20 nt, Artificial Sequence
  CIITA targeting sequence
uugguaugacuuagccucuu

SEQ ID NO: 49172 - RNA, 20 nt, Artificial Sequence
  CIITA targeting sequence
uaccaaggagaugaccuggg

SEQ ID NO: 49173 - RNA, 20 nt, Artificial Sequence
  CIITA targeting sequence
uucugggagcuggaaggaau

SEQ ID NO: 49174 - RNA, 20 nt, Artificial Sequence
  CIITA targeting sequence
gggagcuggaaggaauucag

SEQ ID NO: 49175 - RNA, 20 nt, Artificial Sequence
  CIITA targeting sequence
cagaaagaggcuaagucaua

SEQ ID NO: 49176 - RNA, 20 nt, Artificial Sequence
  CIITA targeting sequence
agcucccagaaagaggcuaa

SEQ ID NO: 49177 - RNA, 20 nt, Artificial Sequence
  CIITA targeting sequence
uuccagcucccagaaagagg

SEQ ID NO: 49178 - RNA, 20 nt, Artificial Sequence
  CIITA targeting sequence
gaaaagcaagauauauuguu

SEQ ID NO: 49179 - RNA, 20 nt, Artificial Sequence
  CIITA targeting sequence
gaauuccuuccagcucccag

SEQ ID NO: 49180 - RNA, 20 nt, Artificial Sequence
  CIITA targeting sequence
ugcuuuucugaauuccuucc

SEQ ID NO: 49181 - RNA, 20 nt, Artificial Sequence
  CIITA targeting sequence
uauuacaucaaugugcaugu

SEQ ID NO: 49182 - RNA, 20 nt, Artificial Sequence
  CIITA targeting sequence
augugcaugugcaggaguua

SEQ ID NO: 49183 - RNA, 20 nt, Artificial Sequence
  CIITA targeting sequence
ugcacaugcacauugaugua

SEQ ID NO: 49184 - RNA, 20 nt, Artificial Sequence
  CIITA targeting sequence
aaguaacuccugcacaugca

SEQ ID NO: 49185 - RNA, 20 nt, Artificial Sequence
  CIITA targeting sequence
agacaaucaucucuucaaug

SEQ ID NO: 49186 - RNA, 20 nt, Artificial Sequence
  CIITA targeting sequence
ggauucuaaguaacuccugc

SEQ ID NO: 49187 - RNA, 20 nt, Artificial Sequence
  CIITA targeting sequence
ucucuucaaugcuaucuucc

SEQ ID NO: 49188 - RNA, 20 nt, Artificial Sequence
  CIITA targeting sequence
cuucaaugcuaucuuccacu

SEQ ID NO: 49189 - RNA, 20 nt, Artificial Sequence
  CIITA targeting sequence
ucaaugcuaucuuccacuau

SEQ ID NO: 49190 - RNA, 20 nt, Artificial Sequence
  CIITA targeting sequence
augcuaucuuccacuauuuu

SEQ ID NO: 49191 - RNA, 20 nt, Artificial Sequence
  CIITA targeting sequence
uccacuauuuugucaagguu

SEQ ID NO: 49192 - RNA, 20 nt, Artificial Sequence
  CIITA targeting sequence
acuauuuugucaagguucua

SEQ ID NO: 49193 - RNA, 20 nt, Artificial Sequence
  CIITA targeting sequence
agguucuaaaugaagcguca

SEQ ID NO: 49194 - RNA, 20 nt, Artificial Sequence
  CIITA targeting sequence
aaaugaagcgucaucuggua

SEQ ID NO: 49195 - RNA, 20 nt, Artificial Sequence
  CIITA targeting sequence
uuuagaaccuugacaaaaua

SEQ ID NO: 49196 - RNA, 20 nt, Artificial Sequence
  CIITA targeting sequence
ucugguacucaagggaccgu

SEQ ID NO: 49197 - RNA, 20 nt, Artificial Sequence
  CIITA targeting sequence
gguacucaagggaccguauu

SEQ ID NO: 49198 - RNA, 20 nt, Artificial Sequence
  CIITA targeting sequence
agggaccguauuuuaagagu

SEQ ID NO: 49199 - RNA, 20 nt, Artificial Sequence
  CIITA targeting sequence
cuugaguaccagaugacgcu

SEQ ID NO: 49200 - RNA, 20 nt, Artificial Sequence
  CIITA targeting sequence
uaaaauacggucccuugagu

SEQ ID NO: 49201 - RNA, 20 nt, Artificial Sequence
  CIITA targeting sequence
gagaagugccaccuuucccc

SEQ ID NO: 49202 - RNA, 20 nt, Artificial Sequence
  CIITA targeting sequence
gaacucuuaaaauacggucc

SEQ ID NO: 49203 - RNA, 20 nt, Artificial Sequence
  CIITA targeting sequence
cggaacucuuaaaauacggu

SEQ ID NO: 49204 - RNA, 20 nt, Artificial Sequence
  CIITA targeting sequence
cccuuuuguagaguaacagg

SEQ ID NO: 49205 - RNA, 20 nt, Artificial Sequence
  CIITA targeting sequence
acaaaagggggaaagguggc

SEQ ID NO: 49206 - RNA, 20 nt, Artificial Sequence
  CIITA targeting sequence
uguuacucuacaaaaggggg

SEQ ID NO: 49207 - RNA, 20 nt, Artificial Sequence
  CIITA targeting sequence
uuuccuguuacucuacaaaa

SEQ ID NO: 49208 - RNA, 20 nt, Artificial Sequence
  CIITA targeting sequence
auucaguucuccaagcuugg

SEQ ID NO: 49209 - RNA, 20 nt, Artificial Sequence
  CIITA targeting sequence
guucuccaagcuuggaucaa

SEQ ID NO: 49210 - RNA, 20 nt, Artificial Sequence
  CIITA targeting sequence
ccaagcuuggaucaagcaaa

SEQ ID NO: 49211 - RNA, 20 nt, Artificial Sequence
  CIITA targeting sequence
aagcuuggaucaagcaaaau

SEQ ID NO: 49212 - RNA, 20 nt, Artificial Sequence
  CIITA targeting sequence
aagcuuggagaacugaaugg

SEQ ID NO: 49213 - RNA, 20 nt, Artificial Sequence
  CIITA targeting sequence
agcaaaauauuuguuucugu

SEQ ID NO: 49214 - RNA, 20 nt, Artificial Sequence
  CIITA targeting sequence
guaaguguauuuuugaagag

SEQ ID NO: 49215 - RNA, 20 nt, Artificial Sequence
  CIITA targeting sequence
aaaauacacuuacagaaaca

SEQ ID NO: 49216 - RNA, 20 nt, Artificial Sequence
  CIITA targeting sequence
ucaaaaauacacuuacagaa

SEQ ID NO: 49217 - RNA, 20 nt, Artificial Sequence
  CIITA targeting sequence
guugagcagauaaggaguuu

SEQ ID NO: 49218 - RNA, 20 nt, Artificial Sequence
  CIITA targeting sequence
acugacguggcucuucaaaa

SEQ ID NO: 49219 - RNA, 20 nt, Artificial Sequence
  CIITA targeting sequence
gcucaacugacguggcucuu

SEQ ID NO: 49220 - RNA, 20 nt, Artificial Sequence
  CIITA targeting sequence
uuaucugcucaacugacgug

SEQ ID NO: 49221 - RNA, 20 nt, Artificial Sequence
  CIITA targeting sequence
aacuccuuaucugcucaacu

SEQ ID NO: 49222 - RNA, 20 nt, Artificial Sequence
  CIITA targeting sequence
ucaaacuccuuaucugcuca

SEQ ID NO: 49223 - RNA, 20 nt, Artificial Sequence
  CIITA targeting sequence
ugacuaccugaccuccucau

SEQ ID NO: 49224 - RNA, 20 nt, Artificial Sequence
  CIITA targeting sequence
acuuacauccuucuccucug

SEQ ID NO: 49225 - RNA, 20 nt, Artificial Sequence
  CIITA targeting sequence
uucuccucuguuccaggcau

SEQ ID NO: 49226 - RNA, 20 nt, Artificial Sequence
  CIITA targeting sequence
ccucuguuccaggcauggau

SEQ ID NO: 49227 - RNA, 20 nt, Artificial Sequence
  CIITA targeting sequence
ucuguuccaggcauggaucc

SEQ ID NO: 49228 - RNA, 20 nt, Artificial Sequence
  CIITA targeting sequence
guuccaggcauggauccuga

SEQ ID NO: 49229 - RNA, 20 nt, Artificial Sequence
  CIITA targeting sequence
aggcauggauccugaaaaau

SEQ ID NO: 49230 - RNA, 20 nt, Artificial Sequence
  CIITA targeting sequence
augccuggaacagaggagaa

SEQ ID NO: 49231 - RNA, 20 nt, Artificial Sequence
  CIITA targeting sequence
ugaaaaauuagagcgaaucc

SEQ ID NO: 49232 - RNA, 20 nt, Artificial Sequence
  CIITA targeting sequence
ggauccaugccuggaacaga

SEQ ID NO: 49233 - RNA, 20 nt, Artificial Sequence
  CIITA targeting sequence
aauuuuucaggauccaugcc

SEQ ID NO: 49234 - RNA, 20 nt, Artificial Sequence
  CIITA targeting sequence
cucuaauuuuucaggaucca

SEQ ID NO: 49235 - RNA, 20 nt, Artificial Sequence
  CIITA targeting sequence
agcuccccgugccaaaugcg

SEQ ID NO: 49236 - RNA, 20 nt, Artificial Sequence
  CIITA targeting sequence
ccgugccaaaugcggccgag

SEQ ID NO: 49237 - RNA, 20 nt, Artificial Sequence
  CIITA targeting sequence
gccgcauuuggcacggggag

SEQ ID NO: 49238 - RNA, 20 nt, Artificial Sequence
  CIITA targeting sequence
cggccgcauuuggcacgggg

SEQ ID NO: 49239 - RNA, 20 nt, Artificial Sequence
  CIITA targeting sequence
ucucggccgcauuuggcacg

SEQ ID NO: 49240 - RNA, 20 nt, Artificial Sequence
  CIITA targeting sequence
gcuagcgggugguuguaggu

SEQ ID NO: 49241 - RNA, 20 nt, Artificial Sequence
  CIITA targeting sequence
uucagcuagcgggugguugu

SEQ ID NO: 49242 - RNA, 20 nt, Artificial Sequence
  CIITA targeting sequence
ucaggaucaugaacaacgcu

SEQ ID NO: 49243 - RNA, 20 nt, Artificial Sequence
  CIITA targeting sequence
ggaucaugaacaacgcugcc

SEQ ID NO: 49244 - RNA, 20 nt, Artificial Sequence
  CIITA targeting sequence
ugaugagucuuucagcuagc

SEQ ID NO: 49245 - RNA, 20 nt, Artificial Sequence
  CIITA targeting sequence
ugaacaacgcugcccagcca

SEQ ID NO: 49246 - RNA, 20 nt, Artificial Sequence
  CIITA targeting sequence
ugauccugaugagucuuuca

SEQ ID NO: 49247 - RNA, 20 nt, Artificial Sequence
  CIITA targeting sequence
guccacagggccacgcaguu

SEQ ID NO: 49248 - RNA, 20 nt, Artificial Sequence
  CIITA targeting sequence
acagggccacgcaguuguag

SEQ ID NO: 49249 - RNA, 20 nt, Artificial Sequence
  CIITA targeting sequence
cagugacuagguaagaacca

SEQ ID NO: 49250 - RNA, 20 nt, Artificial Sequence
  CIITA targeting sequence
cuuggucccagugacuaggu

SEQ ID NO: 49251 - RNA, 20 nt, Artificial Sequence
  CIITA targeting sequence
auauucccuuggucccagug

SEQ ID NO: 49252 - RNA, 20 nt, Artificial Sequence
  CIITA targeting sequence
ccuggccaguuggggugcuc

SEQ ID NO: 49253 - RNA, 20 nt, Artificial Sequence
  CIITA targeting sequence
aggguugggcacaucaccug

SEQ ID NO: 49254 - RNA, 20 nt, Artificial Sequence
  CIITA targeting sequence
ccguuccaggguugggcaca

SEQ ID NO: 49255 - RNA, 20 nt, Artificial Sequence
  CIITA targeting sequence
uuccccguuccaggguuggg

SEQ ID NO: 49256 - RNA, 20 nt, Artificial Sequence
  CIITA targeting sequence
uccuuccccguuccaggguu

SEQ ID NO: 49257 - RNA, 20 nt, Artificial Sequence
  CIITA targeting sequence
gcuccacccaaaucacauga

SEQ ID NO: 49258 - RNA, 20 nt, Artificial Sequence
  CIITA targeting sequence
gcagaugggaagauccggcu

SEQ ID NO: 49259 - RNA, 20 nt, Artificial Sequence
  CIITA targeting sequence
gcagagcacaccaggguaag

SEQ ID NO: 49260 - RNA, 20 nt, Artificial Sequence
  CIITA targeting sequence
caucugcagagcacaccagg

SEQ ID NO: 49261 - RNA, 20 nt, Artificial Sequence
  CIITA targeting sequence
ucccaucugcagagcacacc

SEQ ID NO: 49262 - RNA, 20 nt, Artificial Sequence
  CIITA targeting sequence
ggcuggcgacgcuggagcug

SEQ ID NO: 49263 - RNA, 20 nt, Artificial Sequence
  CIITA targeting sequence
ccagccggaucuucccaucu

SEQ ID NO: 49264 - RNA, 20 nt, Artificial Sequence
  CIITA targeting sequence
agcgucgccagccggaucuu

SEQ ID NO: 49265 - RNA, 20 nt, Artificial Sequence
  CIITA targeting sequence
gcuccagcgucgccagccgg

SEQ ID NO: 49266 - RNA, 20 nt, Artificial Sequence
  CIITA targeting sequence
gaagcagcaaguccugauga

SEQ ID NO: 49267 - RNA, 20 nt, Artificial Sequence
  CIITA targeting sequence
gaagcaggcagcucagcucc

SEQ ID NO: 49268 - RNA, 20 nt, Artificial Sequence
  CIITA targeting sequence
ugaugagugcuggcugcauc

SEQ ID NO: 49269 - RNA, 20 nt, Artificial Sequence
  CIITA targeting sequence
ggacuugcugcuucagaagc

SEQ ID NO: 49270 - RNA, 20 nt, Artificial Sequence
  CIITA targeting sequence
ucaggacuugcugcuucaga

SEQ ID NO: 49271 - RNA, 20 nt, Artificial Sequence
  CIITA targeting sequence
ugaaggacgugcaccuggcc

SEQ ID NO: 49272 - RNA, 20 nt, Artificial Sequence
  CIITA targeting sequence
ugaugcagccagcacucauc

SEQ ID NO: 49273 - RNA, 20 nt, Artificial Sequence
  CIITA targeting sequence
uucaugaugcagccagcacu

SEQ ID NO: 49274 - RNA, 20 nt, Artificial Sequence
  CIITA targeting sequence
aggcaggccaggugcacguc

SEQ ID NO: 49275 - RNA, 20 nt, Artificial Sequence
  CIITA targeting sequence
ccgcuccuccuuccuguggg

SEQ ID NO: 49276 - RNA, 20 nt, Artificial Sequence
  CIITA targeting sequence
gcuccuccuuccugugggcc

SEQ ID NO: 49277 - RNA, 20 nt, Artificial Sequence
  CIITA targeting sequence
uccuuccugugggccaaggg

SEQ ID NO: 49278 - RNA, 20 nt, Artificial Sequence
  CIITA targeting sequence
uuccugugggccaagggaga

SEQ ID NO: 49279 - RNA, 20 nt, Artificial Sequence
  CIITA targeting sequence
ugugggccaagggagaggga

SEQ ID NO: 49280 - RNA, 20 nt, Artificial Sequence
  CIITA targeting sequence
cuuggcccacaggaaggagg

SEQ ID NO: 49281 - RNA, 20 nt, Artificial Sequence
  CIITA targeting sequence
uauuuucuauguuuauuuua

SEQ ID NO: 49282 - RNA, 20 nt, Artificial Sequence
  CIITA targeting sequence
auguuuauuuuagaaaauuu

SEQ ID NO: 49283 - RNA, 20 nt, Artificial Sequence
  CIITA targeting sequence
aaaauaaacauagaaaauaa

SEQ ID NO: 49284 - RNA, 20 nt, Artificial Sequence
  CIITA targeting sequence
uaaauuuucuaaaauaaaca

SEQ ID NO: 49285 - RNA, 20 nt, Artificial Sequence
  CIITA targeting sequence
acuuccuaaauuuucuaaaa

SEQ ID NO: 49286 - RNA, 20 nt, Artificial Sequence
  CIITA targeting sequence
acuauaguuguuacuuuuac

SEQ ID NO: 49287 - RNA, 20 nt, Artificial Sequence
  CIITA targeting sequence
aaacugcuaccagguauuug

SEQ ID NO: 49288 - RNA, 20 nt, Artificial Sequence
  CIITA targeting sequence
cagccuguuuaguguugcug

SEQ ID NO: 49289 - RNA, 20 nt, Artificial Sequence
  CIITA targeting sequence
gcagcaacacuaaacaggcu

SEQ ID NO: 49290 - RNA, 20 nt, Artificial Sequence
  CIITA targeting sequence
ccuccaccuucaagaacugu

SEQ ID NO: 49291 - RNA, 20 nt, Artificial Sequence
  CIITA targeting sequence
accuucaagaacugucagcc

SEQ ID NO: 49292 - RNA, 20 nt, Artificial Sequence
  CIITA targeting sequence
agaacugucagccucuucag

SEQ ID NO: 49293 - RNA, 20 nt, Artificial Sequence
  CIITA targeting sequence
ugaagguggaggggacucag

SEQ ID NO: 49294 - RNA, 20 nt, Artificial Sequence
  CIITA targeting sequence
gccucuucaguaaggagacg

SEQ ID NO: 49295 - RNA, 20 nt, Artificial Sequence
  CIITA targeting sequence
ucaguaaggagacguggggu

SEQ ID NO: 49296 - RNA, 20 nt, Artificial Sequence
  CIITA targeting sequence
guaaggagacgugggguccc

SEQ ID NO: 49297 - RNA, 20 nt, Artificial Sequence
  CIITA targeting sequence
uuacugaagaggcugacagu

SEQ ID NO: 49298 - RNA, 20 nt, Artificial Sequence
  CIITA targeting sequence
ccuuacugaagaggcugaca

SEQ ID NO: 49299 - RNA, 20 nt, Artificial Sequence
  CIITA targeting sequence
cagcuguggcuuccuaagag

SEQ ID NO: 49300 - RNA, 20 nt, Artificial Sequence
  CIITA targeting sequence
uaagagcugagcgugagggc

SEQ ID NO: 49301 - RNA, 20 nt, Artificial Sequence
  CIITA targeting sequence
uaggaagccacagcugggac

SEQ ID NO: 49302 - RNA, 20 nt, Artificial Sequence
  CIITA targeting sequence
gcucuuaggaagccacagcu

SEQ ID NO: 49303 - RNA, 20 nt, Artificial Sequence
  CIITA targeting sequence
cgcucagcucuuaggaagcc

SEQ ID NO: 49304 - RNA, 20 nt, Artificial Sequence
  CIITA targeting sequence
auaaugguauuugggaucug

SEQ ID NO: 49305 - RNA, 20 nt, Artificial Sequence
  CIITA targeting sequence
caaauaccauuauggauggc

SEQ ID NO: 49306 - RNA, 20 nt, Artificial Sequence
  CIITA targeting sequence
gacaagucuccaaaccacuu

SEQ ID NO: 49307 - RNA, 20 nt, Artificial Sequence
  CIITA targeting sequence
gaucccaaauaccauuaugg

SEQ ID NO: 49308 - RNA, 20 nt, Artificial Sequence
  CIITA targeting sequence
ccaaaccacuuguccauaga

SEQ ID NO: 49309 - RNA, 20 nt, Artificial Sequence
  CIITA targeting sequence
aaaccacuuguccauagacc

SEQ ID NO: 49310 - RNA, 20 nt, Artificial Sequence
  CIITA targeting sequence
auagacccuccagggcccug

SEQ ID NO: 49311 - RNA, 20 nt, Artificial Sequence
  CIITA targeting sequence
auggacaagugguuuggaga

SEQ ID NO: 49312 - RNA, 20 nt, Artificial Sequence
  CIITA targeting sequence
agggcccugcacccugagaa

SEQ ID NO: 49313 - RNA, 20 nt, Artificial Sequence
  CIITA targeting sequence
gggugcagggcccuggaggg

SEQ ID NO: 49314 - RNA, 20 nt, Artificial Sequence
  CIITA targeting sequence
cagggugcagggcccuggag

SEQ ID NO: 49315 - RNA, 20 nt, Artificial Sequence
  CIITA targeting sequence
agccccaccaggcugguucu

SEQ ID NO: 49316 - RNA, 20 nt, Artificial Sequence
  CIITA targeting sequence
uaaaaucugcacuuuguccc

SEQ ID NO: 49317 - RNA, 20 nt, Artificial Sequence
  CIITA targeting sequence
gcacuuugucccaguaccgg

SEQ ID NO: 49318 - RNA, 20 nt, Artificial Sequence
  CIITA targeting sequence
caguaccgggugccccaggc

SEQ ID NO: 49319 - RNA, 20 nt, Artificial Sequence
  CIITA targeting sequence
cuucgaggaacccuggaucu

SEQ ID NO: 49320 - RNA, 20 nt, Artificial Sequence
  CIITA targeting sequence
aggaacccuggaucucuccc

SEQ ID NO: 49321 - RNA, 20 nt, Artificial Sequence
  CIITA targeting sequence
aagggaggcccauuggcagc

SEQ ID NO: 49322 - RNA, 20 nt, Artificial Sequence
  CIITA targeting sequence
ucgaagggaggcccauuggc

SEQ ID NO: 49323 - RNA, 20 nt, Artificial Sequence
  CIITA targeting sequence
aggguuccucgaagggaggc

SEQ ID NO: 49324 - RNA, 20 nt, Artificial Sequence
  CIITA targeting sequence
cucccaagacgcugugugug

SEQ ID NO: 49325 - RNA, 20 nt, Artificial Sequence
  CIITA targeting sequence
cccaagacgcugugugugag

SEQ ID NO: 49326 - RNA, 20 nt, Artificial Sequence
  CIITA targeting sequence
caagacgcugugugugagcu

SEQ ID NO: 49327 - RNA, 20 nt, Artificial Sequence
  CIITA targeting sequence
ugggagagauccaggguucc

SEQ ID NO: 49328 - RNA, 20 nt, Artificial Sequence
  CIITA targeting sequence
cacacagcgucuugggagag

SEQ ID NO: 49329 - RNA, 20 nt, Artificial Sequence
  CIITA targeting sequence
gccuuuccaguugccugcac

SEQ ID NO: 49330 - RNA, 20 nt, Artificial Sequence
  CIITA targeting sequence
aguugccugcacauucucgc

SEQ ID NO: 49331 - RNA, 20 nt, Artificial Sequence
  CIITA targeting sequence
cgcccaagugcugugugugg

SEQ ID NO: 49332 - RNA, 20 nt, Artificial Sequence
  CIITA targeting sequence
cccaagugcuguguguggga

SEQ ID NO: 49333 - RNA, 20 nt, Artificial Sequence
  CIITA targeting sequence
cacacacagcacuugggcga

SEQ ID NO: 49334 - RNA, 20 nt, Artificial Sequence
  CIITA targeting sequence
acuccuucguucaagagccu

SEQ ID NO: 49335 - RNA, 20 nt, Artificial Sequence
  CIITA targeting sequence
uucguucaagagccuuuccc

SEQ ID NO: 49336 - RNA, 20 nt, Artificial Sequence
  CIITA targeting sequence
uucaagagccuuucccaccc

SEQ ID NO: 49337 - RNA, 20 nt, Artificial Sequence
  CIITA targeting sequence
agagccuuucccaccccucc

SEQ ID NO: 49338 - RNA, 20 nt, Artificial Sequence
  CIITA targeting sequence
ugaacgaaggaguugaaaag

SEQ ID NO: 49339 - RNA, 20 nt, Artificial Sequence
  CIITA targeting sequence
caccccuccacugggcccag

SEQ ID NO: 49340 - RNA, 20 nt, Artificial Sequence
  CIITA targeting sequence
acugggcccaguccuaugug

SEQ ID NO: 49341 - RNA, 20 nt, Artificial Sequence
  CIITA targeting sequence
uaugugggggccaggacaga

SEQ ID NO: 49342 - RNA, 20 nt, Artificial Sequence
  CIITA targeting sequence
uggcccccacauaggacugg

SEQ ID NO: 49343 - RNA, 20 nt, Artificial Sequence
  CIITA targeting sequence
guccuggcccccacauagga

SEQ ID NO: 49344 - RNA, 20 nt, Artificial Sequence
  CIITA targeting sequence
cuguccuggcccccacauag

SEQ ID NO: 49345 - RNA, 20 nt, Artificial Sequence
  CIITA targeting sequence
cucuguccuggcccccacau

SEQ ID NO: 49346 - RNA, 20 nt, Artificial Sequence
  CIITA targeting sequence
cugccugggcaucucucugu

SEQ ID NO: 49347 - RNA, 20 nt, Artificial Sequence
  CIITA targeting sequence
gacccugcucauccucagag

SEQ ID NO: 49348 - RNA, 20 nt, Artificial Sequence
  CIITA targeting sequence
gaccugcucacugccugggc

SEQ ID NO: 49349 - RNA, 20 nt, Artificial Sequence
  CIITA targeting sequence
uccucagaggccagggugga

SEQ ID NO: 49350 - RNA, 20 nt, Artificial Sequence
  CIITA targeting sequence
ucagaggccaggguggaggg

SEQ ID NO: 49351 - RNA, 20 nt, Artificial Sequence
  CIITA targeting sequence
gaggccaggguggagggagg

SEQ ID NO: 49352 - RNA, 20 nt, Artificial Sequence
  CIITA targeting sequence
gaggaugagcagggucugac

SEQ ID NO: 49353 - RNA, 20 nt, Artificial Sequence
  CIITA targeting sequence
acccuggccucugaggauga

SEQ ID NO: 49354 - RNA, 20 nt, Artificial Sequence
  CIITA targeting sequence
cuccacccuggccucugagg

SEQ ID NO: 49355 - RNA, 20 nt, Artificial Sequence
  CIITA targeting sequence
ccugccucccuccacccugg

SEQ ID NO: 49356 - RNA, 20 nt, Artificial Sequence
  CIITA targeting sequence
ugggucaccugccucccucc

SEQ ID NO: 49357 - RNA, 20 nt, Artificial Sequence
  CIITA targeting sequence
ucaugggucaccugccuccc

SEQ ID NO: 49358 - RNA, 20 nt, Artificial Sequence
  CIITA targeting sequence
cuuccagcagugagaccugu

SEQ ID NO: 49359 - RNA, 20 nt, Artificial Sequence
  CIITA targeting sequence
agcagugagaccuguggcac

SEQ ID NO: 49360 - RNA, 20 nt, Artificial Sequence
  CIITA targeting sequence
cugcuggaagggauuccuca

SEQ ID NO: 49361 - RNA, 20 nt, Artificial Sequence
  CIITA targeting sequence
cacugcuggaagggauuccu

SEQ ID NO: 49362 - RNA, 20 nt, Artificial Sequence
  CIITA targeting sequence
augggcauggggugccacag

SEQ ID NO: 49363 - RNA, 20 nt, Artificial Sequence
  CIITA targeting sequence
uaccuacuugcucugugaca

SEQ ID NO: 49364 - RNA, 20 nt, Artificial Sequence
  CIITA targeting sequence
gugacacggagagacagcug

SEQ ID NO: 49365 - RNA, 20 nt, Artificial Sequence
  CIITA targeting sequence
cagagcaaguagguaugauc

SEQ ID NO: 49366 - RNA, 20 nt, Artificial Sequence
  CIITA targeting sequence
gugucacagagcaaguaggu

SEQ ID NO: 49367 - RNA, 20 nt, Artificial Sequence
  CIITA targeting sequence
ccgugucacagagcaaguag

SEQ ID NO: 49368 - RNA, 20 nt, Artificial Sequence
  CIITA targeting sequence
cuccgugucacagagcaagu

SEQ ID NO: 49369 - RNA, 20 nt, Artificial Sequence
  CIITA targeting sequence
cacacagcugucucuccgug

SEQ ID NO: 49370 - RNA, 20 nt, Artificial Sequence
  CIITA targeting sequence
gugugcucugcagagagcgu

SEQ ID NO: 49371 - RNA, 20 nt, Artificial Sequence
  CIITA targeting sequence
gcagagagcguggcggcuaa

SEQ ID NO: 49372 - RNA, 20 nt, Artificial Sequence
  CIITA targeting sequence
gcagagcacacagaaagccc

SEQ ID NO: 49373 - RNA, 20 nt, Artificial Sequence
  CIITA targeting sequence
cugcagagcacacagaaagc

SEQ ID NO: 49374 - RNA, 20 nt, Artificial Sequence
  CIITA targeting sequence
ccuuagccgccacgcucucu

SEQ ID NO: 49375 - RNA, 20 nt, Artificial Sequence
  CIITA targeting sequence
caugccucaccuuagccgcc

SEQ ID NO: 49376 - RNA, 20 nt, Artificial Sequence
  CIITA targeting sequence
uaacccccaggcugagugag

SEQ ID NO: 49377 - RNA, 20 nt, Artificial Sequence
  CIITA targeting sequence
gccuggggguuaugacuccc

SEQ ID NO: 49378 - RNA, 20 nt, Artificial Sequence
  CIITA targeting sequence
cucagccuggggguuaugac

SEQ ID NO: 49379 - RNA, 20 nt, Artificial Sequence
  CIITA targeting sequence
uggcucacucagccuggggg

SEQ ID NO: 49380 - RNA, 20 nt, Artificial Sequence
  CIITA targeting sequence
ggccacaugcacucuuggcu

SEQ ID NO: 49381 - RNA, 20 nt, Artificial Sequence
  CIITA targeting sequence
uuccaggucagggagcucca

SEQ ID NO: 49382 - RNA, 20 nt, Artificial Sequence
  CIITA targeting sequence
aggucagggagcuccaaggc

SEQ ID NO: 49383 - RNA, 20 nt, Artificial Sequence
  CIITA targeting sequence
gggagcuccaaggcccuggg

SEQ ID NO: 49384 - RNA, 20 nt, Artificial Sequence
  CIITA targeting sequence
cugaccuggaaggaaugggg

SEQ ID NO: 49385 - RNA, 20 nt, Artificial Sequence
  CIITA targeting sequence
aaggcccugggccaggcugc

SEQ ID NO: 49386 - RNA, 20 nt, Artificial Sequence
  CIITA targeting sequence
ugccacccggguuugccagg

SEQ ID NO: 49387 - RNA, 20 nt, Artificial Sequence
  CIITA targeting sequence
uggcaaacccggguggcaug

SEQ ID NO: 49388 - RNA, 20 nt, Artificial Sequence
  CIITA targeting sequence
uucucaugcacggcucaucg

SEQ ID NO: 49389 - RNA, 20 nt, Artificial Sequence
  CIITA targeting sequence
caugcacggcucaucggcag

SEQ ID NO: 49390 - RNA, 20 nt, Artificial Sequence
  CIITA targeting sequence
ugcacggcucaucggcagac

SEQ ID NO: 49391 - RNA, 20 nt, Artificial Sequence
  CIITA targeting sequence
ucggcagacguggagcagag

SEQ ID NO: 49392 - RNA, 20 nt, Artificial Sequence
  CIITA targeting sequence
gcagacguggagcagagcug

SEQ ID NO: 49393 - RNA, 20 nt, Artificial Sequence
  CIITA targeting sequence
gccgaugagccgugcaugag

SEQ ID NO: 49394 - RNA, 20 nt, Artificial Sequence
  CIITA targeting sequence
acgucugccgaugagccgug

SEQ ID NO: 49395 - RNA, 20 nt, Artificial Sequence
  CIITA targeting sequence
gcuccacgucugccgaugag

SEQ ID NO: 49396 - RNA, 20 nt, Artificial Sequence
  CIITA targeting sequence
cacggucccacacaguggac

SEQ ID NO: 49397 - RNA, 20 nt, Artificial Sequence
  CIITA targeting sequence
cacacaguggacagggucuc

SEQ ID NO: 49398 - RNA, 20 nt, Artificial Sequence
  CIITA targeting sequence
acugugugggaccgugggaa

SEQ ID NO: 49399 - RNA, 20 nt, Artificial Sequence
  CIITA targeting sequence
cguuuucuucccucuaaccc

SEQ ID NO: 49400 - RNA, 20 nt, Artificial Sequence
  CIITA targeting sequence
uuuucuucccucuaacccuu

SEQ ID NO: 49401 - RNA, 20 nt, Artificial Sequence
  CIITA targeting sequence
ucccucuaacccuucgcugu

SEQ ID NO: 49402 - RNA, 20 nt, Artificial Sequence
  CIITA targeting sequence
cucuaacccuucgcugucca

SEQ ID NO: 49403 - RNA, 20 nt, Artificial Sequence
  CIITA targeting sequence
aacccuucgcuguccaacac

SEQ ID NO: 49404 - RNA, 20 nt, Artificial Sequence
  CIITA targeting sequence
cuguccaacacgguagccac

SEQ ID NO: 49405 - RNA, 20 nt, Artificial Sequence
  CIITA targeting sequence
aacacgguagccacuugugg

SEQ ID NO: 49406 - RNA, 20 nt, Artificial Sequence
  CIITA targeting sequence
aaaucuacauuaaugaaaau

SEQ ID NO: 49407 - RNA, 20 nt, Artificial Sequence
  CIITA targeting sequence
acauuaaugaaaauuaaggu

SEQ ID NO: 49408 - RNA, 20 nt, Artificial Sequence
  CIITA targeting sequence
uuaauguagauuuagacagc

SEQ ID NO: 49409 - RNA, 20 nt, Artificial Sequence
  CIITA targeting sequence
guuccacugucacaccacau

SEQ ID NO: 49410 - RNA, 20 nt, Artificial Sequence
  CIITA targeting sequence
acugucacaccacauuucaa

SEQ ID NO: 49411 - RNA, 20 nt, Artificial Sequence
  CIITA targeting sequence
caccacauuucaagugcuca

SEQ ID NO: 49412 - RNA, 20 nt, Artificial Sequence
  CIITA targeting sequence
agugcucagucguggauagc

SEQ ID NO: 49413 - RNA, 20 nt, Artificial Sequence
  CIITA targeting sequence
gucguggauagcaagacaac

SEQ ID NO: 49414 - RNA, 20 nt, Artificial Sequence
  CIITA targeting sequence
uggauagcaagacaacggaa

SEQ ID NO: 49415 - RNA, 20 nt, Artificial Sequence
  CIITA targeting sequence
acgacugagcacuugaaaug

SEQ ID NO: 49416 - RNA, 20 nt, Artificial Sequence
  CIITA targeting sequence
ugcuauccacgacugagcac

SEQ ID NO: 49417 - RNA, 20 nt, Artificial Sequence
  CIITA targeting sequence
guugucuugcuauccacgac

SEQ ID NO: 49418 - RNA, 20 nt, Artificial Sequence
  CIITA targeting sequence
uuuuuccguugucuugcuau

SEQ ID NO: 49419 - RNA, 20 nt, Artificial Sequence
  CIITA targeting sequence
auuaaaauuaaauacaauua

SEQ ID NO: 49420 - RNA, 20 nt, Artificial Sequence
  CIITA targeting sequence
guacuagacagcauggucgu

SEQ ID NO: 49421 - RNA, 20 nt, Artificial Sequence
  CIITA targeting sequence
aguacagagccaccacacau

SEQ ID NO: 49422 - RNA, 20 nt, Artificial Sequence
  CIITA targeting sequence
uaggacauuuccaucaaugc

SEQ ID NO: 49423 - RNA, 20 nt, Artificial Sequence
  CIITA targeting sequence
uacgaccaugcugucuagua

SEQ ID NO: 49424 - RNA, 20 nt, Artificial Sequence
  CIITA targeting sequence
aucaaugcagaaaguccuuu

SEQ ID NO: 49425 - RNA, 20 nt, Artificial Sequence
  CIITA targeting sequence
augcagaaaguccuuuuggg

SEQ ID NO: 49426 - RNA, 20 nt, Artificial Sequence
  CIITA targeting sequence
gcauugauggaaauguccua

SEQ ID NO: 49427 - RNA, 20 nt, Artificial Sequence
  CIITA targeting sequence
uuuugggcagcagcgcuguc

SEQ ID NO: 49428 - RNA, 20 nt, Artificial Sequence
  CIITA targeting sequence
agcaggugggguaaaaucag

SEQ ID NO: 49429 - RNA, 20 nt, Artificial Sequence
  CIITA targeting sequence
ggaaacaagaaaggcaaggg

SEQ ID NO: 49430 - RNA, 20 nt, Artificial Sequence
  CIITA targeting sequence
ugauuuuaccccaccugcua

SEQ ID NO: 49431 - RNA, 20 nt, Artificial Sequence
  CIITA targeting sequence
uguuuccugauuuuacccca

SEQ ID NO: 49432 - RNA, 20 nt, Artificial Sequence
  CIITA targeting sequence
aaacccuugccuuucuuguu

SEQ ID NO: 49433 - RNA, 20 nt, Artificial Sequence
  CIITA targeting sequence
uucaggaucccagcuccguc

SEQ ID NO: 49434 - RNA, 20 nt, Artificial Sequence
  CIITA targeting sequence
ggaucccagcuccgucacuu

SEQ ID NO: 49435 - RNA, 20 nt, Artificial Sequence
  CIITA targeting sequence
ugaaagacuccaaacccuug

SEQ ID NO: 49436 - RNA, 20 nt, Artificial Sequence
  CIITA targeting sequence
cagcuccgucacuuucuagu

SEQ ID NO: 49437 - RNA, 20 nt, Artificial Sequence
  CIITA targeting sequence
gucacuuucuaguguguggc

SEQ ID NO: 49438 - RNA, 20 nt, Artificial Sequence
  CIITA targeting sequence
cuuucuaguguguggcugca

SEQ ID NO: 49439 - RNA, 20 nt, Artificial Sequence
  CIITA targeting sequence
aguguguggcugcaugcugu

SEQ ID NO: 49440 - RNA, 20 nt, Artificial Sequence
  CIITA targeting sequence
acucugcuggggcccaggcg

SEQ ID NO: 49441 - RNA, 20 nt, Artificial Sequence
  CIITA targeting sequence
gcuggggcccaggcguccuc

SEQ ID NO: 49442 - RNA, 20 nt, Artificial Sequence
  CIITA targeting sequence
ucgucuggaacugaaagccc

SEQ ID NO: 49443 - RNA, 20 nt, Artificial Sequence
  CIITA targeting sequence
ucuggaacugaaagcccaga

SEQ ID NO: 49444 - RNA, 20 nt, Artificial Sequence
  CIITA targeting sequence
ggaacugaaagcccagauuu

SEQ ID NO: 49445 - RNA, 20 nt, Artificial Sequence
  CIITA targeting sequence
agacgaggacgccugggccc

SEQ ID NO: 49446 - RNA, 20 nt, Artificial Sequence
  CIITA targeting sequence
guuccagacgaggacgccug

SEQ ID NO: 49447 - RNA, 20 nt, Artificial Sequence
  CIITA targeting sequence
gggcuuucaguuccagacga

SEQ ID NO: 49448 - RNA, 20 nt, Artificial Sequence
  CIITA targeting sequence
ucacccaggugcgaggacgg

SEQ ID NO: 49449 - RNA, 20 nt, Artificial Sequence
  CIITA targeting sequence
cccaggugcgaggacggggc

SEQ ID NO: 49450 - RNA, 20 nt, Artificial Sequence
  CIITA targeting sequence
caccugggugaggagguagc

SEQ ID NO: 49451 - RNA, 20 nt, Artificial Sequence
  CIITA targeting sequence
ucgcaccugggugaggaggu

SEQ ID NO: 49452 - RNA, 20 nt, Artificial Sequence
  CIITA targeting sequence
cuuugccccguccucgcacc

SEQ ID NO: 49453 - RNA, 20 nt, Artificial Sequence
  CIITA targeting sequence
ucacuuugccccguccucgc

SEQ ID NO: 49454 - RNA, 20 nt, Artificial Sequence
  CIITA targeting sequence
guuacuguuaccauccucac

SEQ ID NO: 49455 - RNA, 20 nt, Artificial Sequence
  CIITA targeting sequence
acaccucuguuacuguuacc

SEQ ID NO: 49456 - RNA, 20 nt, Artificial Sequence
  CIITA targeting sequence
cugcuuucauucuucccugc

SEQ ID NO: 49457 - RNA, 20 nt, Artificial Sequence
  CIITA targeting sequence
gcuuucauucuucccugccu

SEQ ID NO: 49458 - RNA, 20 nt, Artificial Sequence
  CIITA targeting sequence
uucuucccugccugggaccc

SEQ ID NO: 49459 - RNA, 20 nt, Artificial Sequence
  CIITA targeting sequence
ucccugccugggacccacgu

SEQ ID NO: 49460 - RNA, 20 nt, Artificial Sequence
  CIITA targeting sequence
cugccugggacccacgugcu

SEQ ID NO: 49461 - RNA, 20 nt, Artificial Sequence
  CIITA targeting sequence
caggcagggaagaaugaaag

SEQ ID NO: 49462 - RNA, 20 nt, Artificial Sequence
  CIITA targeting sequence
ccccuguuuacagaugggaa

SEQ ID NO: 49463 - RNA, 20 nt, Artificial Sequence
  CIITA targeting sequence
guaaacaggggugaaaacag

SEQ ID NO: 49464 - RNA, 20 nt, Artificial Sequence
  CIITA targeting sequence
caucuguaaacaggggugaa

SEQ ID NO: 49465 - RNA, 20 nt, Artificial Sequence
  CIITA targeting sequence
acuuucccaucuguaaacag

SEQ ID NO: 49466 - RNA, 20 nt, Artificial Sequence
  CIITA targeting sequence
gggccucuacuuucccaucu

SEQ ID NO: 49467 - RNA, 20 nt, Artificial Sequence
  CIITA targeting sequence
agcauguggcaggaagcaga

SEQ ID NO: 49468 - RNA, 20 nt, Artificial Sequence
  CIITA targeting sequence
ugccacaugcuggacacuua

SEQ ID NO: 49469 - RNA, 20 nt, Artificial Sequence
  CIITA targeting sequence
gcuuccugccacaugcugga

SEQ ID NO: 49470 - RNA, 20 nt, Artificial Sequence
  CIITA targeting sequence
cugcuuccugccacaugcug

SEQ ID NO: 49471 - RNA, 20 nt, Artificial Sequence
  CIITA targeting sequence
ccacugucucugcuuccugc

SEQ ID NO: 49472 - RNA, 20 nt, Artificial Sequence
  CIITA targeting sequence
caauccccacugucucugcu

SEQ ID NO: 49473 - RNA, 20 nt, Artificial Sequence
  CIITA targeting sequence
uaccuaucuagccagaguug

SEQ ID NO: 49474 - RNA, 20 nt, Artificial Sequence
  CIITA targeting sequence
agccagaguugcaccugggg

SEQ ID NO: 49475 - RNA, 20 nt, Artificial Sequence
  CIITA targeting sequence
ggcuagauagguaagaauca

SEQ ID NO: 49476 - RNA, 20 nt, Artificial Sequence
  CIITA targeting sequence
aaaccccaggugcaacucug

SEQ ID NO: 49477 - RNA, 20 nt, Artificial Sequence
  CIITA targeting sequence
gccgugccuccaaaccccag

SEQ ID NO: 49478 - RNA, 20 nt, Artificial Sequence
  CIITA targeting sequence
acaccccugccaacugucug

SEQ ID NO: 49479 - RNA, 20 nt, Artificial Sequence
  CIITA targeting sequence
gaccacgguggcucugccua

SEQ ID NO: 49480 - RNA, 20 nt, Artificial Sequence
  CIITA targeting sequence
gacaguuggcagggguguag

SEQ ID NO: 49481 - RNA, 20 nt, Artificial Sequence
  CIITA targeting sequence
gccuaugacacacuuauuua

SEQ ID NO: 49482 - RNA, 20 nt, Artificial Sequence
  CIITA targeting sequence
uaggcagagccaccgugguc

SEQ ID NO: 49483 - RNA, 20 nt, Artificial Sequence
  CIITA targeting sequence
aauaguaaauaaguguguca

SEQ ID NO: 49484 - RNA, 20 nt, Artificial Sequence
  CIITA targeting sequence
ggcuguccaauaguaaauaa

SEQ ID NO: 49485 - RNA, 20 nt, Artificial Sequence
  CIITA targeting sequence
uuucuuaacuuuugccuaaa

SEQ ID NO: 49486 - RNA, 20 nt, Artificial Sequence
  CIITA targeting sequence
uaacuuuugccuaaaaaaaa

SEQ ID NO: 49487 - RNA, 20 nt, Artificial Sequence
  CIITA targeting sequence
auccauggcuuccuagcucu

SEQ ID NO: 49488 - RNA, 20 nt, Artificial Sequence
  CIITA targeting sequence
auggcuuccuagcucugaac

SEQ ID NO: 49489 - RNA, 20 nt, Artificial Sequence
  CIITA targeting sequence
uagcucugaacuugccucug

SEQ ID NO: 49490 - RNA, 20 nt, Artificial Sequence
  CIITA targeting sequence
gaacuugccucugugcauca

SEQ ID NO: 49491 - RNA, 20 nt, Artificial Sequence
  CIITA targeting sequence
gagcuaggaagccauggauu

SEQ ID NO: 49492 - RNA, 20 nt, Artificial Sequence
  CIITA targeting sequence
gugcaucaagcugaagaagg

SEQ ID NO: 49493 - RNA, 20 nt, Artificial Sequence
  CIITA targeting sequence
agcugaagaaggugcaggag

SEQ ID NO: 49494 - RNA, 20 nt, Artificial Sequence
  CIITA targeting sequence
gcuugaugcacagaggcaag

SEQ ID NO: 49495 - RNA, 20 nt, Artificial Sequence
  CIITA targeting sequence
ucagcuugaugcacagaggc

SEQ ID NO: 49496 - RNA, 20 nt, Artificial Sequence
  CIITA targeting sequence
ugcaccuucuucagcuugau

SEQ ID NO: 49497 - RNA, 20 nt, Artificial Sequence
  CIITA targeting sequence
gagccagucauuccuuaaca

SEQ ID NO: 49498 - RNA, 20 nt, Artificial Sequence
  CIITA targeting sequence
gaaacuccugcaccuucuuc

SEQ ID NO: 49499 - RNA, 20 nt, Artificial Sequence
  CIITA targeting sequence
uuccuuaacagggagguaag

SEQ ID NO: 49500 - RNA, 20 nt, Artificial Sequence
  CIITA targeting sequence
uuaacagggagguaagacug

SEQ ID NO: 49501 - RNA, 20 nt, Artificial Sequence
  CIITA targeting sequence
cuguuaaggaaugacuggcu

SEQ ID NO: 49502 - RNA, 20 nt, Artificial Sequence
  CIITA targeting sequence
uaccucccuguuaaggaaug

SEQ ID NO: 49503 - RNA, 20 nt, Artificial Sequence
  CIITA targeting sequence
cccgcagucuuaccucccug

SEQ ID NO: 49504 - RNA, 20 nt, Artificial Sequence
  CIITA targeting sequence
gcaauuuggagccugggcuu

SEQ ID NO: 49505 - RNA, 20 nt, Artificial Sequence
  CIITA targeting sequence
aaauugcugagucccccgca

SEQ ID NO: 49506 - RNA, 20 nt, Artificial Sequence
  CIITA targeting sequence
caccaccuaucaugcccucc

SEQ ID NO: 49507 - RNA, 20 nt, Artificial Sequence
  CIITA targeting sequence
ccaccuaucaugcccuccua

SEQ ID NO: 49508 - RNA, 20 nt, Artificial Sequence
  CIITA targeting sequence
ugcccuccuacgguccugcc

SEQ ID NO: 49509 - RNA, 20 nt, Artificial Sequence
  CIITA targeting sequence
uacgguccugccaaaaucuc

SEQ ID NO: 49510 - RNA, 20 nt, Artificial Sequence
  CIITA targeting sequence
ugccaaaaucuccugucucu

SEQ ID NO: 49511 - RNA, 20 nt, Artificial Sequence
  CIITA targeting sequence
ccugucucucuuucaccuuu

SEQ ID NO: 49512 - RNA, 20 nt, Artificial Sequence
  CIITA targeting sequence
ugucucucuuucaccuuucc

SEQ ID NO: 49513 - RNA, 20 nt, Artificial Sequence
  CIITA targeting sequence
cucuuucaccuuucccuuuc

SEQ ID NO: 49514 - RNA, 20 nt, Artificial Sequence
  CIITA targeting sequence
cuuucaccuuucccuuucuc

SEQ ID NO: 49515 - RNA, 20 nt, Artificial Sequence
  CIITA targeting sequence
uucaccuuucccuuucuccg

SEQ ID NO: 49516 - RNA, 20 nt, Artificial Sequence
  CIITA targeting sequence
ccuuucccuuucuccgccug

SEQ ID NO: 49517 - RNA, 20 nt, Artificial Sequence
  CIITA targeting sequence
cuuucuccgccugcuggugg

SEQ ID NO: 49518 - RNA, 20 nt, Artificial Sequence
  CIITA targeting sequence
ccgccugcugguggauuucc

SEQ ID NO: 49519 - RNA, 20 nt, Artificial Sequence
  CIITA targeting sequence
gccugcugguggauuuccuc

SEQ ID NO: 49520 - RNA, 20 nt, Artificial Sequence
  CIITA targeting sequence
accagcaggcggagaaaggg

SEQ ID NO: 49521 - RNA, 20 nt, Artificial Sequence
  CIITA targeting sequence
ucugccaagaaauuagcaag

SEQ ID NO: 49522 - RNA, 20 nt, Artificial Sequence
  CIITA targeting sequence
gccaagaaauuagcaagagc

SEQ ID NO: 49523 - RNA, 20 nt, Artificial Sequence
  CIITA targeting sequence
uggcagaggaaauccaccag

SEQ ID NO: 49524 - RNA, 20 nt, Artificial Sequence
  CIITA targeting sequence
ugcuaauuucuuggcagagg

SEQ ID NO: 49525 - RNA, 20 nt, Artificial Sequence
  CIITA targeting sequence
gcugcucuugcuaauuucuu

SEQ ID NO: 49526 - RNA, 20 nt, Artificial Sequence
  CIITA targeting sequence
ccgccuucagcugcucuugc

SEQ ID NO: 49527 - RNA, 20 nt, Artificial Sequence
  CIITA targeting sequence
cuuuggccgggccgugugca

SEQ ID NO: 49528 - RNA, 20 nt, Artificial Sequence
  CIITA targeting sequence
ccccugcuccugcugugaaa

SEQ ID NO: 49529 - RNA, 20 nt, Artificial Sequence
  CIITA targeting sequence
ugcugugaaagcugcugauc

SEQ ID NO: 49530 - RNA, 20 nt, Artificial Sequence
  CIITA targeting sequence
cagcaggagcaggggugacu

SEQ ID NO: 49531 - RNA, 20 nt, Artificial Sequence
  CIITA targeting sequence
gcagcuuucacagcaggagc

SEQ ID NO: 49532 - RNA, 20 nt, Artificial Sequence
  CIITA targeting sequence
cuuucuuagcacaggcagcc

SEQ ID NO: 49533 - RNA, 20 nt, Artificial Sequence
  CIITA targeting sequence
uucuuagcacaggcagccaa

SEQ ID NO: 49534 - RNA, 20 nt, Artificial Sequence
  CIITA targeting sequence
uagcacaggcagccaaaugu

SEQ ID NO: 49535 - RNA, 20 nt, Artificial Sequence
  CIITA targeting sequence
gguccagauuucacuaacuu

SEQ ID NO: 49536 - RNA, 20 nt, Artificial Sequence
  CIITA targeting sequence
agauuucacuaacuuagugu

SEQ ID NO: 49537 - RNA, 20 nt, Artificial Sequence
  CIITA targeting sequence
ggaccagaaggguaaaccac

SEQ ID NO: 49538 - RNA, 20 nt, Artificial Sequence
  CIITA targeting sequence
cuaacuuaguguggcccaga

SEQ ID NO: 49539 - RNA, 20 nt, Artificial Sequence
  CIITA targeting sequence
gggccacacuaaguuaguga

SEQ ID NO: 49540 - RNA, 20 nt, Artificial Sequence
  CIITA targeting sequence
cugggccacacuaaguuagu

SEQ ID NO: 49541 - RNA, 20 nt, Artificial Sequence
  CIITA targeting sequence
uuuuacaagauugggguuug

SEQ ID NO: 49542 - RNA, 20 nt, Artificial Sequence
  CIITA targeting sequence
uguaaaaagauucucugggc

SEQ ID NO: 49543 - RNA, 20 nt, Artificial Sequence
  CIITA targeting sequence
agcacauggagggacuugga

SEQ ID NO: 49544 - RNA, 20 nt, Artificial Sequence
  CIITA targeting sequence
augugcuugaaaccaaaccc

SEQ ID NO: 49545 - RNA, 20 nt, Artificial Sequence
  CIITA targeting sequence
cuccaugugcuugaaaccaa

SEQ ID NO: 49546 - RNA, 20 nt, Artificial Sequence
  CIITA targeting sequence
aagucccuccaugugcuuga

SEQ ID NO: 49547 - RNA, 20 nt, Artificial Sequence
  CIITA targeting sequence
gguccaagucccuccaugug

SEQ ID NO: 49548 - RNA, 20 nt, Artificial Sequence
  CIITA targeting sequence
cuugggcauuuccugcuugg

SEQ ID NO: 49549 - RNA, 20 nt, Artificial Sequence
  CIITA targeting sequence
ugcuugggguccugggaauu

SEQ ID NO: 49550 - RNA, 20 nt, Artificial Sequence
  CIITA targeting sequence
ugggaauugaccucccggaa

SEQ ID NO: 49551 - RNA, 20 nt, Artificial Sequence
  CIITA targeting sequence
caggaccccaagcaggaaau

SEQ ID NO: 49552 - RNA, 20 nt, Artificial Sequence
  CIITA targeting sequence
auucccaggaccccaagcag

SEQ ID NO: 49553 - RNA, 20 nt, Artificial Sequence
  CIITA targeting sequence
cggaagauaacauuagcagc

SEQ ID NO: 49554 - RNA, 20 nt, Artificial Sequence
  CIITA targeting sequence
gggaggucaauucccaggac

SEQ ID NO: 49555 - RNA, 20 nt, Artificial Sequence
  CIITA targeting sequence
uccgggaggucaauucccag

SEQ ID NO: 49556 - RNA, 20 nt, Artificial Sequence
  CIITA targeting sequence
agucaguuacugacccucuc

SEQ ID NO: 49557 - RNA, 20 nt, Artificial Sequence
  CIITA targeting sequence
guuacugacccucucagggu

SEQ ID NO: 49558 - RNA, 20 nt, Artificial Sequence
  CIITA targeting sequence
guaacugacuugagguugug

SEQ ID NO: 49559 - RNA, 20 nt, Artificial Sequence
  CIITA targeting sequence
cagggucucagcuuucucau

SEQ ID NO: 49560 - RNA, 20 nt, Artificial Sequence
  CIITA targeting sequence
gggucucagcuuucucaugu

SEQ ID NO: 49561 - RNA, 20 nt, Artificial Sequence
  CIITA targeting sequence
cagcuuucucauguguaaug

SEQ ID NO: 49562 - RNA, 20 nt, Artificial Sequence
  CIITA targeting sequence
gcuuucucauguguaaugug

SEQ ID NO: 49563 - RNA, 20 nt, Artificial Sequence
  CIITA targeting sequence
cauguguaaugugcagauaa

SEQ ID NO: 49564 - RNA, 20 nt, Artificial Sequence
  CIITA targeting sequence
uguguaaugugcagauaaug

SEQ ID NO: 49565 - RNA, 20 nt, Artificial Sequence
  CIITA targeting sequence
gcacauuacacaugagaaag

SEQ ID NO: 49566 - RNA, 20 nt, Artificial Sequence
  CIITA targeting sequence
aaaccacccagcccaggcag

SEQ ID NO: 49567 - RNA, 20 nt, Artificial Sequence
  CIITA targeting sequence
gugucagaugcuuauuaaau

SEQ ID NO: 49568 - RNA, 20 nt, Artificial Sequence
  CIITA targeting sequence
gaugcuuauuaaauauuaca

SEQ ID NO: 49569 - RNA, 20 nt, Artificial Sequence
  CIITA targeting sequence
gacacugagcuaagcacuca

SEQ ID NO: 49570 - RNA, 20 nt, Artificial Sequence
  CIITA targeting sequence
gaaauuagcauggguauaug

SEQ ID NO: 49571 - RNA, 20 nt, Artificial Sequence
  CIITA targeting sequence
gauacuaacaguuacagugu

SEQ ID NO: 49572 - RNA, 20 nt, Artificial Sequence
  CIITA targeting sequence
agccacuugcaaacauauac

SEQ ID NO: 49573 - RNA, 20 nt, Artificial Sequence
  CIITA targeting sequence
aaaguuccagccacuugcaa

SEQ ID NO: 49574 - RNA, 20 nt, Artificial Sequence
  CIITA targeting sequence
ucaaaaguuccagccacuug

SEQ ID NO: 49575 - RNA, 20 nt, Artificial Sequence
  CIITA targeting sequence
gcaaacccugcaaauaaacu

SEQ ID NO: 49576 - RNA, 20 nt, Artificial Sequence
  CIITA targeting sequence
ucugcaaacccugcaaauaa

SEQ ID NO: 49577 - RNA, 20 nt, Artificial Sequence
  CIITA targeting sequence
guaacggguugaauauaccu

SEQ ID NO: 49578 - RNA, 20 nt, Artificial Sequence
  CIITA targeting sequence
acccguuacagacuuuguuu

SEQ ID NO: 49579 - RNA, 20 nt, Artificial Sequence
  CIITA targeting sequence
auugugcugguacaguuuau

SEQ ID NO: 49580 - RNA, 20 nt, Artificial Sequence
  CIITA targeting sequence
cagauuucuuucaguuacug

SEQ ID NO: 49581 - RNA, 20 nt, Artificial Sequence
  CIITA targeting sequence
gugaguauaaacuguaccag

SEQ ID NO: 49582 - RNA, 20 nt, Artificial Sequence
  CIITA targeting sequence
uucaguuacugcuuuauggu

SEQ ID NO: 49583 - RNA, 20 nt, Artificial Sequence
  CIITA targeting sequence
guuacugcuuuauggucugu

SEQ ID NO: 49584 - RNA, 20 nt, Artificial Sequence
  CIITA targeting sequence
gucuguugagacuguggcug

SEQ ID NO: 49585 - RNA, 20 nt, Artificial Sequence
  CIITA targeting sequence
guugagacuguggcugcgug

SEQ ID NO: 49586 - RNA, 20 nt, Artificial Sequence
  CIITA targeting sequence
acagacagaccauaaagcag

SEQ ID NO: 49587 - RNA, 20 nt, Artificial Sequence
  CIITA targeting sequence
caacagacagaccauaaagc

SEQ ID NO: 49588 - RNA, 20 nt, Artificial Sequence
  CIITA targeting sequence
cgcagccacagucucaacag

SEQ ID NO: 49589 - RNA, 20 nt, Artificial Sequence
  CIITA targeting sequence
ggcccucacgcagccacagu

SEQ ID NO: 49590 - RNA, 20 nt, Artificial Sequence
  CIITA targeting sequence
uuuucagcccugcagcccua

SEQ ID NO: 49591 - RNA, 20 nt, Artificial Sequence
  CIITA targeting sequence
gcccugcagcccuaguaccu

SEQ ID NO: 49592 - RNA, 20 nt, Artificial Sequence
  CIITA targeting sequence
cagguacuagggcugcaggg

SEQ ID NO: 49593 - RNA, 20 nt, Artificial Sequence
  CIITA targeting sequence
acuaugggccaagcacaguc

SEQ ID NO: 49594 - RNA, 20 nt, Artificial Sequence
  CIITA targeting sequence
aacaguuacuguguaucuac

SEQ ID NO: 49595 - RNA, 20 nt, Artificial Sequence
  CIITA targeting sequence
ucaaacaguuacuguguauc

SEQ ID NO: 49596 - RNA, 20 nt, Artificial Sequence
  CIITA targeting sequence
uuuauuuauuaauucaucaa

SEQ ID NO: 49597 - RNA, 20 nt, Artificial Sequence
  CIITA targeting sequence
uguuauuuuuucuuaauaug

SEQ ID NO: 49598 - RNA, 20 nt, Artificial Sequence
  CIITA targeting sequence
uaauaugcuuaguaaacucu

SEQ ID NO: 49599 - RNA, 20 nt, Artificial Sequence
  CIITA targeting sequence
uuguucguguuauauuuuaa

SEQ ID NO: 49600 - RNA, 20 nt, Artificial Sequence
  CIITA targeting sequence
uguuauauuuuaaguuccag

SEQ ID NO: 49601 - RNA, 20 nt, Artificial Sequence
  CIITA targeting sequence
aguccaggucuucauuauaa

SEQ ID NO: 49602 - RNA, 20 nt, Artificial Sequence
  CIITA targeting sequence
aggucuucauuauaagcuuc

SEQ ID NO: 49603 - RNA, 20 nt, Artificial Sequence
  CIITA targeting sequence
ucauuauaagcuuccaauua

SEQ ID NO: 49604 - RNA, 20 nt, Artificial Sequence
  CIITA targeting sequence
uuauaagcuuccaauuaagg

SEQ ID NO: 49605 - RNA, 20 nt, Artificial Sequence
  CIITA targeting sequence
aauuaagggccugaguuaca

SEQ ID NO: 49606 - RNA, 20 nt, Artificial Sequence
  CIITA targeting sequence
ggcccuuaauuggaagcuua

SEQ ID NO: 49607 - RNA, 20 nt, Artificial Sequence
  CIITA targeting sequence
cugaauaaugauaggcaaaa

SEQ ID NO: 49608 - RNA, 20 nt, Artificial Sequence
  CIITA targeting sequence
gugaaauguaacucaggccc

SEQ ID NO: 49609 - RNA, 20 nt, Artificial Sequence
  CIITA targeting sequence
uuauucagugaaauguaacu

SEQ ID NO: 49610 - RNA, 20 nt, Artificial Sequence
  CIITA targeting sequence
guucucgcagugaucuuccu

SEQ ID NO: 49611 - RNA, 20 nt, Artificial Sequence
  CIITA targeting sequence
cgcagugaucuuccuagugu

SEQ ID NO: 49612 - RNA, 20 nt, Artificial Sequence
  CIITA targeting sequence
cagugaucuuccuagugucc

SEQ ID NO: 49613 - RNA, 20 nt, Artificial Sequence
  CIITA targeting sequence
cugcgagaacugaagguuuu

SEQ ID NO: 49614 - RNA, 20 nt, Artificial Sequence
  CIITA targeting sequence
uccuaguguccccaguuccu

SEQ ID NO: 49615 - RNA, 20 nt, Artificial Sequence
  CIITA targeting sequence
uaguguccccaguuccuggg

SEQ ID NO: 49616 - RNA, 20 nt, Artificial Sequence
  CIITA targeting sequence
ccaguuccugggcaacuauu

SEQ ID NO: 49617 - RNA, 20 nt, Artificial Sequence
  CIITA targeting sequence
ugggcaacuauuuauagucc

SEQ ID NO: 49618 - RNA, 20 nt, Artificial Sequence
  CIITA targeting sequence
uagguguggcuuuaauaagc

SEQ ID NO: 49619 - RNA, 20 nt, Artificial Sequence
  CIITA targeting sequence
acaaggguggcuuauuaaag

SEQ ID NO: 49620 - RNA, 20 nt, Artificial Sequence
  CIITA targeting sequence
ccacccuccgcagccucacc

SEQ ID NO: 49621 - RNA, 20 nt, Artificial Sequence
  CIITA targeting sequence
gcagccucacccccaacagu

SEQ ID NO: 49622 - RNA, 20 nt, Artificial Sequence
  CIITA targeting sequence
cccccaacaguccucacugc

SEQ ID NO: 49623 - RNA, 20 nt, Artificial Sequence
  CIITA targeting sequence
ucacugcccucuuccucaua

SEQ ID NO: 49624 - RNA, 20 nt, Artificial Sequence
  CIITA targeting sequence
cugcccucuuccucauaucc

SEQ ID NO: 49625 - RNA, 20 nt, Artificial Sequence
  CIITA targeting sequence
uccucauaucccagccccaa

SEQ ID NO: 49626 - RNA, 20 nt, Artificial Sequence
  CIITA targeting sequence
ucauaucccagccccaacaa

SEQ ID NO: 49627 - RNA, 20 nt, Artificial Sequence
  CIITA targeting sequence
uaucccagccccaacaaagg

SEQ ID NO: 49628 - RNA, 20 nt, Artificial Sequence
  CIITA targeting sequence
cagccccaacaaaggacagg

SEQ ID NO: 49629 - RNA, 20 nt, Artificial Sequence
  CIITA targeting sequence
uuuguuggggcugggauaug

SEQ ID NO: 49630 - RNA, 20 nt, Artificial Sequence
  CIITA targeting sequence
uguccuuuguuggggcuggg

SEQ ID NO: 49631 - RNA, 20 nt, Artificial Sequence
  CIITA targeting sequence
caaacucaccauguucccuc

SEQ ID NO: 49632 - RNA, 20 nt, Artificial Sequence
  CIITA targeting sequence
ccauguucccuccugccucu

SEQ ID NO: 49633 - RNA, 20 nt, Artificial Sequence
  CIITA targeting sequence
cuccugccucuggcccaugg

SEQ ID NO: 49634 - RNA, 20 nt, Artificial Sequence
  CIITA targeting sequence
ugccucuggcccaugguaca

SEQ ID NO: 49635 - RNA, 20 nt, Artificial Sequence
  CIITA targeting sequence
ggcccaugguacaugccccu

SEQ ID NO: 49636 - RNA, 20 nt, Artificial Sequence
  CIITA targeting sequence
cugcauguccuugacugucg

SEQ ID NO: 49637 - RNA, 20 nt, Artificial Sequence
  CIITA targeting sequence
uugacugucgcacucugcgu

SEQ ID NO: 49638 - RNA, 20 nt, Artificial Sequence
  CIITA targeting sequence
aggacaugcagggaaggggc

SEQ ID NO: 49639 - RNA, 20 nt, Artificial Sequence
  CIITA targeting sequence
cacucugcgugucacacucu

SEQ ID NO: 49640 - RNA, 20 nt, Artificial Sequence
  CIITA targeting sequence
gcgugucacacucugcgugu

SEQ ID NO: 49641 - RNA, 20 nt, Artificial Sequence
  CIITA targeting sequence
cacucugcgugucuuguuca

SEQ ID NO: 49642 - RNA, 20 nt, Artificial Sequence
  CIITA targeting sequence
gcgugucuuguucauucugu

SEQ ID NO: 49643 - RNA, 20 nt, Artificial Sequence
  CIITA targeting sequence
uguucauucuguuuucuccc

SEQ ID NO: 49644 - RNA, 20 nt, Artificial Sequence
  CIITA targeting sequence
uucuguuuucucccuacugg

SEQ ID NO: 49645 - RNA, 20 nt, Artificial Sequence
  CIITA targeting sequence
guuuucucccuacugggcug

SEQ ID NO: 49646 - RNA, 20 nt, Artificial Sequence
  CIITA targeting sequence
cccuacugggcugugagguc

SEQ ID NO: 49647 - RNA, 20 nt, Artificial Sequence
  CIITA targeting sequence
cuacugggcugugagguccu

SEQ ID NO: 49648 - RNA, 20 nt, Artificial Sequence
  CIITA targeting sequence
cagcccaguagggagaaaac

SEQ ID NO: 49649 - RNA, 20 nt, Artificial Sequence
  CIITA targeting sequence
uacagagcagggacugagcc

SEQ ID NO: 49650 - RNA, 20 nt, Artificial Sequence
  CIITA targeting sequence
guaggaccucacagcccagu

SEQ ID NO: 49651 - RNA, 20 nt, Artificial Sequence
  CIITA targeting sequence
cugcucuguaggaccucaca

SEQ ID NO: 49652 - RNA, 20 nt, Artificial Sequence
  CIITA targeting sequence
gucccugcucuguaggaccu

SEQ ID NO: 49653 - RNA, 20 nt, Artificial Sequence
  CIITA targeting sequence
ugucucuccaacaccuugga

SEQ ID NO: 49654 - RNA, 20 nt, Artificial Sequence
  CIITA targeting sequence
cuccaacaccuuggaugucc

SEQ ID NO: 49655 - RNA, 20 nt, Artificial Sequence
  CIITA targeting sequence
ccaacaccuuggauguccaa

SEQ ID NO: 49656 - RNA, 20 nt, Artificial Sequence
  CIITA targeting sequence
aacaccuuggauguccaagg

SEQ ID NO: 49657 - RNA, 20 nt, Artificial Sequence
  CIITA targeting sequence
aagguguuggagagacaaga

SEQ ID NO: 49658 - RNA, 20 nt, Artificial Sequence
  CIITA targeting sequence
aagguaggcaucccuccucu

SEQ ID NO: 49659 - RNA, 20 nt, Artificial Sequence
  CIITA targeting sequence
cuccucuccacagacgucua

SEQ ID NO: 49660 - RNA, 20 nt, Artificial Sequence
  CIITA targeting sequence
ucuccacagacgucuaguga

SEQ ID NO: 49661 - RNA, 20 nt, Artificial Sequence
  CIITA targeting sequence
ccacagacgucuagugagca

SEQ ID NO: 49662 - RNA, 20 nt, Artificial Sequence
  CIITA targeting sequence
acagacgucuagugagcaca

SEQ ID NO: 49663 - RNA, 20 nt, Artificial Sequence
  CIITA targeting sequence
guggagaggagggaugccua

SEQ ID NO: 49664 - RNA, 20 nt, Artificial Sequence
  CIITA targeting sequence
agugagcacauaccgugugc

SEQ ID NO: 49665 - RNA, 20 nt, Artificial Sequence
  CIITA targeting sequence
cuagacgucuguggagagga

SEQ ID NO: 49666 - RNA, 20 nt, Artificial Sequence
  CIITA targeting sequence
uggccaggcacacgguaugu

SEQ ID NO: 49667 - RNA, 20 nt, Artificial Sequence
  CIITA targeting sequence
cugcucauggccaggcacac

SEQ ID NO: 49668 - RNA, 20 nt, Artificial Sequence
  CIITA targeting sequence
uuuuuguucacugcucaugg

SEQ ID NO: 49669 - RNA, 20 nt, Artificial Sequence
  CIITA targeting sequence
uugcccucauagaacuaaug

SEQ ID NO: 49670 - RNA, 20 nt, Artificial Sequence
  CIITA targeting sequence
uagaacuaauguucuagaag

SEQ ID NO: 49671 - RNA, 20 nt, Artificial Sequence
  CIITA targeting sequence
augagggcaaggauuuuugu

SEQ ID NO: 49672 - RNA, 20 nt, Artificial Sequence
  CIITA targeting sequence
agaagauacuccauaaaagu

SEQ ID NO: 49673 - RNA, 20 nt, Artificial Sequence
  CIITA targeting sequence
agaacauuaguucuaugagg

SEQ ID NO: 49674 - RNA, 20 nt, Artificial Sequence
  CIITA targeting sequence
ucuagaacauuaguucuaug

SEQ ID NO: 49675 - RNA, 20 nt, Artificial Sequence
  CIITA targeting sequence
auaaaaguuucuugaaugaa

SEQ ID NO: 49676 - RNA, 20 nt, Artificial Sequence
  CIITA targeting sequence
ugaaugaauggagcucccuu

SEQ ID NO: 49677 - RNA, 20 nt, Artificial Sequence
  CIITA targeting sequence
agaaacuuuuauggaguauc

SEQ ID NO: 49678 - RNA, 20 nt, Artificial Sequence
  CIITA targeting sequence
uucaagaaacuuuuauggag

SEQ ID NO: 49679 - RNA, 20 nt, Artificial Sequence
  CIITA targeting sequence
auucauucaagaaacuuuua

SEQ ID NO: 49680 - RNA, 20 nt, Artificial Sequence
  CIITA targeting sequence
cuuuuuuauuuugcccuuca

SEQ ID NO: 49681 - RNA, 20 nt, Artificial Sequence
  CIITA targeting sequence
ugaauuucauaaguaguucg

SEQ ID NO: 49682 - RNA, 20 nt, Artificial Sequence
  CIITA targeting sequence
ugaagggcaaaauaaaaaag

SEQ ID NO: 49683 - RNA, 20 nt, Artificial Sequence
  CIITA targeting sequence
uaaguaguucguguacaagu

SEQ ID NO: 49684 - RNA, 20 nt, Artificial Sequence
  CIITA targeting sequence
uguacaaguucauuuuuuuc

SEQ ID NO: 49685 - RNA, 20 nt, Artificial Sequence
  CIITA targeting sequence
uuuuuuucuuuucuuuucuu

SEQ ID NO: 49686 - RNA, 20 nt, Artificial Sequence
  CIITA targeting sequence
uuucuuuucuuuucuuuuuu

SEQ ID NO: 49687 - RNA, 20 nt, Artificial Sequence
  CIITA targeting sequence
uuucuuuucuuuuuuuuuug

SEQ ID NO: 49688 - RNA, 20 nt, Artificial Sequence
  CIITA targeting sequence
uuucuuuuuuuuuugaaaca

SEQ ID NO: 49689 - RNA, 20 nt, Artificial Sequence
  CIITA targeting sequence
uuuuuuuuugaaacagggua

SEQ ID NO: 49690 - RNA, 20 nt, Artificial Sequence
  CIITA targeting sequence
aaaaaaaaagaaaagaaaag

SEQ ID NO: 49691 - RNA, 20 nt, Artificial Sequence
  CIITA targeting sequence
uucuguugcccaaguuggag

SEQ ID NO: 49692 - RNA, 20 nt, Artificial Sequence
  CIITA targeting sequence
guugcccaaguuggagugca

SEQ ID NO: 49693 - RNA, 20 nt, Artificial Sequence
  CIITA targeting sequence
aacuugggcaacagaaggau

SEQ ID NO: 49694 - RNA, 20 nt, Artificial Sequence
  CIITA targeting sequence
cugcacuccaacuugggcaa

SEQ ID NO: 49695 - RNA, 20 nt, Artificial Sequence
  CIITA targeting sequence
cuguagcuuugaccucccua

SEQ ID NO: 49696 - RNA, 20 nt, Artificial Sequence
  CIITA targeting sequence
aagcuacagugaccauaauu

SEQ ID NO: 49697 - RNA, 20 nt, Artificial Sequence
  CIITA targeting sequence
cuaggcucaagugauccucc

SEQ ID NO: 49698 - RNA, 20 nt, Artificial Sequence
  CIITA targeting sequence
agugauccucccaccucagc

SEQ ID NO: 49699 - RNA, 20 nt, Artificial Sequence
  CIITA targeting sequence
cuugagccuagggaggucaa

SEQ ID NO: 49700 - RNA, 20 nt, Artificial Sequence
  CIITA targeting sequence
ucccaccucagccccccgag

SEQ ID NO: 49701 - RNA, 20 nt, Artificial Sequence
  CIITA targeting sequence
caccucagccccccgaguag

SEQ ID NO: 49702 - RNA, 20 nt, Artificial Sequence
  CIITA targeting sequence
gccccccgaguagcugggac

SEQ ID NO: 49703 - RNA, 20 nt, Artificial Sequence
  CIITA targeting sequence
gggggcugaggugggaggau

SEQ ID NO: 49704 - RNA, 20 nt, Artificial Sequence
  CIITA targeting sequence
cagcuacucggggggcugag

SEQ ID NO: 49705 - RNA, 20 nt, Artificial Sequence
  CIITA targeting sequence
agauaauuuuugcuuuuuuu

SEQ ID NO: 49706 - RNA, 20 nt, Artificial Sequence
  CIITA targeting sequence
ggaugugguggugugcaccu

SEQ ID NO: 49707 - RNA, 20 nt, Artificial Sequence
  CIITA targeting sequence
cuacaaaaaaaaaaaaaaaa

SEQ ID NO: 49708 - RNA, 20 nt, Artificial Sequence
  CIITA targeting sequence
ugccauguugccuaggcugg

SEQ ID NO: 49709 - RNA, 20 nt, Artificial Sequence
  CIITA targeting sequence
caaacucuugggcuugagca

SEQ ID NO: 49710 - RNA, 20 nt, Artificial Sequence
  CIITA targeting sequence
aacucuugggcuugagcaau

SEQ ID NO: 49711 - RNA, 20 nt, Artificial Sequence
  CIITA targeting sequence
ugggcuugagcaaucugccu

SEQ ID NO: 49712 - RNA, 20 nt, Artificial Sequence
  CIITA targeting sequence
agcccaagaguuugagacca

SEQ ID NO: 49713 - RNA, 20 nt, Artificial Sequence
  CIITA targeting sequence
gccuaccucagccucccaaa

SEQ ID NO: 49714 - RNA, 20 nt, Artificial Sequence
  CIITA targeting sequence
gccucccaaaguguugggau

SEQ ID NO: 49715 - RNA, 20 nt, Artificial Sequence
  CIITA targeting sequence
caaaguguugggauuauagg

SEQ ID NO: 49716 - RNA, 20 nt, Artificial Sequence
  CIITA targeting sequence
caacacuuugggaggcugag

SEQ ID NO: 49717 - RNA, 20 nt, Artificial Sequence
  CIITA targeting sequence
caccuauaaucccaacacuu

SEQ ID NO: 49718 - RNA, 20 nt, Artificial Sequence
  CIITA targeting sequence
uuuuuaaaagaauuaaaaac

SEQ ID NO: 49719 - RNA, 20 nt, Artificial Sequence
  CIITA targeting sequence
uuuaaaaaugaacuaggugc

SEQ ID NO: 49720 - RNA, 20 nt, Artificial Sequence
  CIITA targeting sequence
gagggaaaaauaguuugaga

SEQ ID NO: 49721 - RNA, 20 nt, Artificial Sequence
  CIITA targeting sequence
gaguuuuuaauucuuuuaaa

SEQ ID NO: 49722 - RNA, 20 nt, Artificial Sequence
  CIITA targeting sequence
cucugaguuuuuaauucuuu

SEQ ID NO: 49723 - RNA, 20 nt, Artificial Sequence
  CIITA targeting sequence
aacuauuuuucccucugagu

SEQ ID NO: 49724 - RNA, 20 nt, Artificial Sequence
  CIITA targeting sequence
caaacuauuuuucccucuga

SEQ ID NO: 49725 - RNA, 20 nt, Artificial Sequence
  CIITA targeting sequence
ccauuuuuaccauggcugaa

SEQ ID NO: 49726 - RNA, 20 nt, Artificial Sequence
  CIITA targeting sequence
auuuuuaccauggcugaaac

SEQ ID NO: 49727 - RNA, 20 nt, Artificial Sequence
  CIITA targeting sequence
gccaugguaaaaauggagaa

SEQ ID NO: 49728 - RNA, 20 nt, Artificial Sequence
  CIITA targeting sequence
gauugggggugugguauugu

SEQ ID NO: 49729 - RNA, 20 nt, Artificial Sequence
  CIITA targeting sequence
gauggccuuauuuaaacuac

SEQ ID NO: 49730 - RNA, 20 nt, Artificial Sequence
  CIITA targeting sequence
gcacagcuguguguaauaca

SEQ ID NO: 49731 - RNA, 20 nt, Artificial Sequence
  CIITA targeting sequence
uaucagcacagcugugugua

SEQ ID NO: 49732 - RNA, 20 nt, Artificial Sequence
  CIITA targeting sequence
cuuaaaucacaugcuuccag

SEQ ID NO: 49733 - RNA, 20 nt, Artificial Sequence
  CIITA targeting sequence
caugcuuccagaauguugcu

SEQ ID NO: 49734 - RNA, 20 nt, Artificial Sequence
  CIITA targeting sequence
agaauguugcucugcugccc

SEQ ID NO: 49735 - RNA, 20 nt, Artificial Sequence
  CIITA targeting sequence
ggaagcaugugauuuaagug

SEQ ID NO: 49736 - RNA, 20 nt, Artificial Sequence
  CIITA targeting sequence
gcugcccaaaguuuauuagu

SEQ ID NO: 49737 - RNA, 20 nt, Artificial Sequence
  CIITA targeting sequence
guuugaacacaaaagauuaa

SEQ ID NO: 49738 - RNA, 20 nt, Artificial Sequence
  CIITA targeting sequence
aacugauuacuaauaaacuu

SEQ ID NO: 49739 - RNA, 20 nt, Artificial Sequence
  CIITA targeting sequence
uuuguguucaaacugauuac

SEQ ID NO: 49740 - RNA, 20 nt, Artificial Sequence
  CIITA targeting sequence
cugcuuuacguuuuuaaucu

SEQ ID NO: 49741 - RNA, 20 nt, Artificial Sequence
  CIITA targeting sequence
caaaccaaauucccugcuuu

SEQ ID NO: 49742 - RNA, 20 nt, Artificial Sequence
  CIITA targeting sequence
aaagguacagcuugucucca

SEQ ID NO: 49743 - RNA, 20 nt, Artificial Sequence
  CIITA targeting sequence
ccaccagaggucuccuauau

SEQ ID NO: 49744 - RNA, 20 nt, Artificial Sequence
  CIITA targeting sequence
accagaggucuccuauauuu

SEQ ID NO: 49745 - RNA, 20 nt, Artificial Sequence
  CIITA targeting sequence
gguggagacaagcuguaccu

SEQ ID NO: 49746 - RNA, 20 nt, Artificial Sequence
  CIITA targeting sequence
ccuauauuuuacuguuaaug

SEQ ID NO: 49747 - RNA, 20 nt, Artificial Sequence
  CIITA targeting sequence
uauauuuuacuguuaauguu

SEQ ID NO: 49748 - RNA, 20 nt, Artificial Sequence
  CIITA targeting sequence
aacauuaacaguaaaauaua

SEQ ID NO: 49749 - RNA, 20 nt, Artificial Sequence
  CIITA targeting sequence
auauacuucaaacauuaaca

SEQ ID NO: 49750 - RNA, 20 nt, Artificial Sequence
  CIITA targeting sequence
cacaagcuaauuaaaaauca

SEQ ID NO: 49751 - RNA, 20 nt, Artificial Sequence
  CIITA targeting sequence
gacugcugugccgguaagca

SEQ ID NO: 49752 - RNA, 20 nt, Artificial Sequence
  CIITA targeting sequence
gauuuuuaauuagcuugugg

SEQ ID NO: 49753 - RNA, 20 nt, Artificial Sequence
  CIITA targeting sequence
cucugugaacuaauuucugc

SEQ ID NO: 49754 - RNA, 20 nt, Artificial Sequence
  CIITA targeting sequence
gugaacuaauuucugccaaa

SEQ ID NO: 49755 - RNA, 20 nt, Artificial Sequence
  CIITA targeting sequence
cagagugaaugcuuaccggc

SEQ ID NO: 49756 - RNA, 20 nt, Artificial Sequence
  CIITA targeting sequence
gccaaacggcuauaaaugug

SEQ ID NO: 49757 - RNA, 20 nt, Artificial Sequence
  CIITA targeting sequence
ccugguaugaaauuuagaca

SEQ ID NO: 49758 - RNA, 20 nt, Artificial Sequence
  CIITA targeting sequence
uaccaggggacacauuuaua

SEQ ID NO: 49759 - RNA, 20 nt, Artificial Sequence
  CIITA targeting sequence
aaauuucauaccaggggaca

SEQ ID NO: 49760 - RNA, 20 nt, Artificial Sequence
  CIITA targeting sequence
uucccaucagaaaagaggca

SEQ ID NO: 49761 - RNA, 20 nt, Artificial Sequence
  CIITA targeting sequence
caucagaaaagaggcaugug

SEQ ID NO: 49762 - RNA, 20 nt, Artificial Sequence
  CIITA targeting sequence
gaaaagaggcaugugguuua

SEQ ID NO: 49763 - RNA, 20 nt, Artificial Sequence
  CIITA targeting sequence
gaugggaaagaaugucuaaa

SEQ ID NO: 49764 - RNA, 20 nt, Artificial Sequence
  CIITA targeting sequence
uuucugaugggaaagaaugu

SEQ ID NO: 49765 - RNA, 20 nt, Artificial Sequence
  CIITA targeting sequence
caaccgcuucauuugaguga

SEQ ID NO: 49766 - RNA, 20 nt, Artificial Sequence
  CIITA targeting sequence
uuugagugacaaggaagcug

SEQ ID NO: 49767 - RNA, 20 nt, Artificial Sequence
  CIITA targeting sequence
aaugaagcgguugggacuaa

SEQ ID NO: 49768 - RNA, 20 nt, Artificial Sequence
  CIITA targeting sequence
cucaaaugaagcgguuggga

SEQ ID NO: 49769 - RNA, 20 nt, Artificial Sequence
  CIITA targeting sequence
uugucacucaaaugaagcgg

SEQ ID NO: 49770 - RNA, 20 nt, Artificial Sequence
  CIITA targeting sequence
gcuuccuugucacucaaaug

SEQ ID NO: 49771 - RNA, 20 nt, Artificial Sequence
  CIITA targeting sequence
accuggaaaggucgguugcc

SEQ ID NO: 49772 - RNA, 20 nt, Artificial Sequence
  CIITA targeting sequence
agguggaccucagcuuccuu

SEQ ID NO: 49773 - RNA, 20 nt, Artificial Sequence
  CIITA targeting sequence
guugcccugacugaggccac

SEQ ID NO: 49774 - RNA, 20 nt, Artificial Sequence
  CIITA targeting sequence
gggcaaccgaccuuuccagg

SEQ ID NO: 49775 - RNA, 20 nt, Artificial Sequence
  CIITA targeting sequence
gucagggcaaccgaccuuuc

SEQ ID NO: 49776 - RNA, 20 nt, Artificial Sequence
  CIITA targeting sequence
gacccaggccccuucuccau

SEQ ID NO: 49777 - RNA, 20 nt, Artificial Sequence
  CIITA targeting sequence
gaugcccaguggggccacuu

SEQ ID NO: 49778 - RNA, 20 nt, Artificial Sequence
  CIITA targeting sequence
ccaucucagcucaguguucu

SEQ ID NO: 49779 - RNA, 20 nt, Artificial Sequence
  CIITA targeting sequence
aucucagcucaguguucucc

SEQ ID NO: 49780 - RNA, 20 nt, Artificial Sequence
  CIITA targeting sequence
cagcucaguguucuccccac

SEQ ID NO: 49781 - RNA, 20 nt, Artificial Sequence
  CIITA targeting sequence
gcucaguguucuccccacca

SEQ ID NO: 49782 - RNA, 20 nt, Artificial Sequence
  CIITA targeting sequence
guguucuccccaccaaaucc

SEQ ID NO: 49783 - RNA, 20 nt, Artificial Sequence
  CIITA targeting sequence
ccccaccaaauccugcuggu

SEQ ID NO: 49784 - RNA, 20 nt, Artificial Sequence
  CIITA targeting sequence
ccaccaaauccugcugguuc

SEQ ID NO: 49785 - RNA, 20 nt, Artificial Sequence
  CIITA targeting sequence
ugcugguucuugcugggugg

SEQ ID NO: 49786 - RNA, 20 nt, Artificial Sequence
  CIITA targeting sequence
ugcuggguggaacucagaga

SEQ ID NO: 49787 - RNA, 20 nt, Artificial Sequence
  CIITA targeting sequence
acccagcaagaaccagcagg

SEQ ID NO: 49788 - RNA, 20 nt, Artificial Sequence
  CIITA targeting sequence
gagagcugcuguuacuccua

SEQ ID NO: 49789 - RNA, 20 nt, Artificial Sequence
  CIITA targeting sequence
gaguuccacccagcaagaac

SEQ ID NO: 49790 - RNA, 20 nt, Artificial Sequence
  CIITA targeting sequence
cugaguuccacccagcaaga

SEQ ID NO: 49791 - RNA, 20 nt, Artificial Sequence
  CIITA targeting sequence
uaagugccaggcacuauccu

SEQ ID NO: 49792 - RNA, 20 nt, Artificial Sequence
  CIITA targeting sequence
uagcaccuuacaaacaucau

SEQ ID NO: 49793 - RNA, 20 nt, Artificial Sequence
  CIITA targeting sequence
uugaguuuucauaguaacac

SEQ ID NO: 49794 - RNA, 20 nt, Artificial Sequence
  CIITA targeting sequence
augauguuuguaaggugcua

SEQ ID NO: 49795 - RNA, 20 nt, Artificial Sequence
  CIITA targeting sequence
uaguaacacuauagggacag

SEQ ID NO: 49796 - RNA, 20 nt, Artificial Sequence
  CIITA targeting sequence
cuauaguguuacuaugaaaa

SEQ ID NO: 49797 - RNA, 20 nt, Artificial Sequence
  CIITA targeting sequence
ccucuauuugcugaugaggu

SEQ ID NO: 49798 - RNA, 20 nt, Artificial Sequence
  CIITA targeting sequence
auuugcugaugagguaccug

SEQ ID NO: 49799 - RNA, 20 nt, Artificial Sequence
  CIITA targeting sequence
gcaaauagaggugauauuaa

SEQ ID NO: 49800 - RNA, 20 nt, Artificial Sequence
  CIITA targeting sequence
ucagcaaauagaggugauau

SEQ ID NO: 49801 - RNA, 20 nt, Artificial Sequence
  CIITA targeting sequence
gguaccucaucagcaaauag

SEQ ID NO: 49802 - RNA, 20 nt, Artificial Sequence
  CIITA targeting sequence
ggcccucagguaccucauca

SEQ ID NO: 49803 - RNA, 20 nt, Artificial Sequence
  CIITA targeting sequence
ccucuggcccucagguaccu

SEQ ID NO: 49804 - RNA, 20 nt, Artificial Sequence
  CIITA targeting sequence
ccccucuggcccucagguac

SEQ ID NO: 49805 - RNA, 20 nt, Artificial Sequence
  CIITA targeting sequence
gcuuguugccgucuccccuc

SEQ ID NO: 49806 - RNA, 20 nt, Artificial Sequence
  CIITA targeting sequence
cacacugguaaggggcagag

SEQ ID NO: 49807 - RNA, 20 nt, Artificial Sequence
  CIITA targeting sequence
gccccuuaccagugugggac

SEQ ID NO: 49808 - RNA, 20 nt, Artificial Sequence
  CIITA targeting sequence
gucuaaagcagcaggcggcc

SEQ ID NO: 49809 - RNA, 20 nt, Artificial Sequence
  CIITA targeting sequence
aaagcagcaggcggccuggu

SEQ ID NO: 49810 - RNA, 20 nt, Artificial Sequence
  CIITA targeting sequence
ucacugugccuucaccacaa

SEQ ID NO: 49811 - RNA, 20 nt, Artificial Sequence
  CIITA targeting sequence
cugugccuucaccacaaggc

SEQ ID NO: 49812 - RNA, 20 nt, Artificial Sequence
  CIITA targeting sequence
ccacaaggcugaacuguccc

SEQ ID NO: 49813 - RNA, 20 nt, Artificial Sequence
  CIITA targeting sequence
gccuuguggugaaggcacag

SEQ ID NO: 49814 - RNA, 20 nt, Artificial Sequence
  CIITA targeting sequence
cuggaggcugaaacucaggg

SEQ ID NO: 49815 - RNA, 20 nt, Artificial Sequence
  CIITA targeting sequence
agggacaguucagccuugug

SEQ ID NO: 49816 - RNA, 20 nt, Artificial Sequence
  CIITA targeting sequence
gccuccagggacaguucagc

SEQ ID NO: 49817 - RNA, 20 nt, Artificial Sequence
  CIITA targeting sequence
gggacagacacagagggagg

SEQ ID NO: 49818 - RNA, 20 nt, Artificial Sequence
  CIITA targeting sequence
cugaguuucagccuccaggg

SEQ ID NO: 49819 - RNA, 20 nt, Artificial Sequence
  CIITA targeting sequence
gucccugaguuucagccucc

SEQ ID NO: 49820 - RNA, 20 nt, Artificial Sequence
  CIITA targeting sequence
gugucugucccugaguuuca

SEQ ID NO: 49821 - RNA, 20 nt, Artificial Sequence
  CIITA targeting sequence
cucugugucugucccugagu

SEQ ID NO: 49822 - RNA, 20 nt, Artificial Sequence
  CIITA targeting sequence
ggcccucccucugugucugu

SEQ ID NO: 49823 - RNA, 20 nt, Artificial Sequence
  CIITA targeting sequence
caggcccucccucugugucu

SEQ ID NO: 49824 - RNA, 20 nt, Artificial Sequence
  CIITA targeting sequence
cucaggcccucccucugugu

SEQ ID NO: 49825 - RNA, 20 nt, Artificial Sequence
  CIITA targeting sequence
cuugcccaucucucaggccc

SEQ ID NO: 49826 - RNA, 20 nt, Artificial Sequence
  CIITA targeting sequence
ccggaccuucuggcggaaau

SEQ ID NO: 49827 - RNA, 20 nt, Artificial Sequence
  CIITA targeting sequence
ggggagcauucgcuugccca

SEQ ID NO: 49828 - RNA, 20 nt, Artificial Sequence
  CIITA targeting sequence
ggcggaaaugaggugaagag

SEQ ID NO: 49829 - RNA, 20 nt, Artificial Sequence
  CIITA targeting sequence
gccagaagguccggggagca

SEQ ID NO: 49830 - RNA, 20 nt, Artificial Sequence
  CIITA targeting sequence
uuuccgccagaagguccggg

SEQ ID NO: 49831 - RNA, 20 nt, Artificial Sequence
  CIITA targeting sequence
ccucauuuccgccagaaggu

SEQ ID NO: 49832 - RNA, 20 nt, Artificial Sequence
  CIITA targeting sequence
ucaccucauuuccgccagaa

SEQ ID NO: 49833 - RNA, 20 nt, Artificial Sequence
  CIITA targeting sequence
aaccccagagguuuggugga

SEQ ID NO: 49834 - RNA, 20 nt, Artificial Sequence
  CIITA targeting sequence
gggguuugaggcucuucacc

SEQ ID NO: 49835 - RNA, 20 nt, Artificial Sequence
  CIITA targeting sequence
accaaaccucugggguuuga

SEQ ID NO: 49836 - RNA, 20 nt, Artificial Sequence
  CIITA targeting sequence
cauuuuccaccaaaccucug

SEQ ID NO: 49837 - RNA, 20 nt, Artificial Sequence
  CIITA targeting sequence
gauccaagaauaugcugggg

SEQ ID NO: 49838 - RNA, 20 nt, Artificial Sequence
  CIITA targeting sequence
gacccuugugggcccagcac

SEQ ID NO: 49839 - RNA, 20 nt, Artificial Sequence
  CIITA targeting sequence
aagaauaugcuggggaggag

SEQ ID NO: 49840 - RNA, 20 nt, Artificial Sequence
  CIITA targeting sequence
uggaucugacccuugugggc

SEQ ID NO: 49841 - RNA, 20 nt, Artificial Sequence
  CIITA targeting sequence
ccagcauauucuuggaucug

SEQ ID NO: 49842 - RNA, 20 nt, Artificial Sequence
  CIITA targeting sequence
uccccagcauauucuuggau

SEQ ID NO: 49843 - RNA, 20 nt, Artificial Sequence
  CIITA targeting sequence
ccccagagaggcccaguggc

SEQ ID NO: 49844 - RNA, 20 nt, Artificial Sequence
  CIITA targeting sequence
ggggggacugcuggcuccuc

SEQ ID NO: 49845 - RNA, 20 nt, Artificial Sequence
  CIITA targeting sequence
cuggggggacugcuggcucc

SEQ ID NO: 49846 - RNA, 20 nt, Artificial Sequence
  CIITA targeting sequence
ccaccucugcuuggcccauu

SEQ ID NO: 49847 - RNA, 20 nt, Artificial Sequence
  CIITA targeting sequence
accucugcuuggcccauugc

SEQ ID NO: 49848 - RNA, 20 nt, Artificial Sequence
  CIITA targeting sequence
gcuuggcccauugcugggcu

SEQ ID NO: 49849 - RNA, 20 nt, Artificial Sequence
  CIITA targeting sequence
uucaagaucaauuuaaaaca

SEQ ID NO: 49850 - RNA, 20 nt, Artificial Sequence
  CIITA targeting sequence
agaucaauuuaaaacauuac

SEQ ID NO: 49851 - RNA, 20 nt, Artificial Sequence
  CIITA targeting sequence
ugaaagaagcccagcaaugg

SEQ ID NO: 49852 - RNA, 20 nt, Artificial Sequence
  CIITA targeting sequence
auuuaaaacauuaccuccug

SEQ ID NO: 49853 - RNA, 20 nt, Artificial Sequence
  CIITA targeting sequence
ugacugggcacagggcucac

SEQ ID NO: 49854 - RNA, 20 nt, Artificial Sequence
  CIITA targeting sequence
ggagguaauguuuuaaauug

SEQ ID NO: 49855 - RNA, 20 nt, Artificial Sequence
  CIITA targeting sequence
cuccuguaaucccagcacuu

SEQ ID NO: 49856 - RNA, 20 nt, Artificial Sequence
  CIITA targeting sequence
uguaaucccagcacuuuggg

SEQ ID NO: 49857 - RNA, 20 nt, Artificial Sequence
  CIITA targeting sequence
cagcacuuugggaggcugag

SEQ ID NO: 49858 - RNA, 20 nt, Artificial Sequence
  CIITA targeting sequence
caaagugcugggauuacagg

SEQ ID NO: 49859 - RNA, 20 nt, Artificial Sequence
  CIITA targeting sequence
gccucccaaagugcugggau

SEQ ID NO: 49860 - RNA, 20 nt, Artificial Sequence
  CIITA targeting sequence
gcccaccucagccucccaaa

SEQ ID NO: 49861 - RNA, 20 nt, Artificial Sequence
  CIITA targeting sequence
ccugagaucagggguuugag

SEQ ID NO: 49862 - RNA, 20 nt, Artificial Sequence
  CIITA targeting sequence
ggugauccgcccaccucagc

SEQ ID NO: 49863 - RNA, 20 nt, Artificial Sequence
  CIITA targeting sequence
caggugauccgcccaccuca

SEQ ID NO: 49864 - RNA, 20 nt, Artificial Sequence
  CIITA targeting sequence
gggguuugagaccagccugg

SEQ ID NO: 49865 - RNA, 20 nt, Artificial Sequence
  CIITA targeting sequence
aaccccugaucucaggugau

SEQ ID NO: 49866 - RNA, 20 nt, Artificial Sequence
  CIITA targeting sequence
caaaccccugaucucaggug

SEQ ID NO: 49867 - RNA, 20 nt, Artificial Sequence
  CIITA targeting sequence
ccauguuggccaggcugguc

SEQ ID NO: 49868 - RNA, 20 nt, Artificial Sequence
  CIITA targeting sequence
cuacugaaaauacaaaaauu

SEQ ID NO: 49869 - RNA, 20 nt, Artificial Sequence
  CIITA targeting sequence
acugaaaauacaaaaauuag

SEQ ID NO: 49870 - RNA, 20 nt, Artificial Sequence
  CIITA targeting sequence
guagagacaggguuucacca

SEQ ID NO: 49871 - RNA, 20 nt, Artificial Sequence
  CIITA targeting sequence
uagcuacucagguggcugac

SEQ ID NO: 49872 - RNA, 20 nt, Artificial Sequence
  CIITA targeting sequence
gguggcugacacaggggaau

SEQ ID NO: 49873 - RNA, 20 nt, Artificial Sequence
  CIITA targeting sequence
gccaccugaguagcuaggac

SEQ ID NO: 49874 - RNA, 20 nt, Artificial Sequence
  CIITA targeting sequence
ccugugucagccaccugagu

SEQ ID NO: 49875 - RNA, 20 nt, Artificial Sequence
  CIITA targeting sequence
cuugaaccuggcagguggag

SEQ ID NO: 49876 - RNA, 20 nt, Artificial Sequence
  CIITA targeting sequence
agugauuccccugugucagc

SEQ ID NO: 49877 - RNA, 20 nt, Artificial Sequence
  CIITA targeting sequence
accugccagguucaagugau

SEQ ID NO: 49878 - RNA, 20 nt, Artificial Sequence
  CIITA targeting sequence
uggcuuauugcaaccuccac

SEQ ID NO: 49879 - RNA, 20 nt, Artificial Sequence
  CIITA targeting sequence
agccugggcaacacaacaaa

SEQ ID NO: 49880 - RNA, 20 nt, Artificial Sequence
  CIITA targeting sequence
gucucaaaaaaauaaaaaua

SEQ ID NO: 49881 - RNA, 20 nt, Artificial Sequence
  CIITA targeting sequence
caaaaaaauaaaaauaaauc

SEQ ID NO: 49882 - RNA, 20 nt, Artificial Sequence
  CIITA targeting sequence
aaaaaauaaaaauaaaucac

SEQ ID NO: 49883 - RNA, 20 nt, Artificial Sequence
  CIITA targeting sequence
ccuccugcaagaagccuucu

SEQ ID NO: 49884 - RNA, 20 nt, Artificial Sequence
  CIITA targeting sequence
ugcaagaagccuucucugac

SEQ ID NO: 49885 - RNA, 20 nt, Artificial Sequence
  CIITA targeting sequence
ugcaggaggugauuuauuuu

SEQ ID NO: 49886 - RNA, 20 nt, Artificial Sequence
  CIITA targeting sequence
cugacccuugggcuguguca

SEQ ID NO: 49887 - RNA, 20 nt, Artificial Sequence
  CIITA targeting sequence
gacccuugggcugugucaug

SEQ ID NO: 49888 - RNA, 20 nt, Artificial Sequence
  CIITA targeting sequence
gagaaggcuucuugcaggag

SEQ ID NO: 49889 - RNA, 20 nt, Artificial Sequence
  CIITA targeting sequence
uggccugucuuccagcaguc

SEQ ID NO: 49890 - RNA, 20 nt, Artificial Sequence
  CIITA targeting sequence
uccagcagucuacauccucc

SEQ ID NO: 49891 - RNA, 20 nt, Artificial Sequence
  CIITA targeting sequence
agcagucuacauccuccugg

SEQ ID NO: 49892 - RNA, 20 nt, Artificial Sequence
  CIITA targeting sequence
acauccuccuggucuucccc

SEQ ID NO: 49893 - RNA, 20 nt, Artificial Sequence
  CIITA targeting sequence
uccuggucuuccccugcugu

SEQ ID NO: 49894 - RNA, 20 nt, Artificial Sequence
  CIITA targeting sequence
uggucuuccccugcuguggc

SEQ ID NO: 49895 - RNA, 20 nt, Artificial Sequence
  CIITA targeting sequence
uccccugcuguggcucuugu

SEQ ID NO: 49896 - RNA, 20 nt, Artificial Sequence
  CIITA targeting sequence
ccugcuguggcucuuguccc

SEQ ID NO: 49897 - RNA, 20 nt, Artificial Sequence
  CIITA targeting sequence
ugucccauggcauguaauug

SEQ ID NO: 49898 - RNA, 20 nt, Artificial Sequence
  CIITA targeting sequence
cauggcauguaauugucacu

SEQ ID NO: 49899 - RNA, 20 nt, Artificial Sequence
  CIITA targeting sequence
cuucuuugggcucccaugcu

SEQ ID NO: 49900 - RNA, 20 nt, Artificial Sequence
  CIITA targeting sequence
uugggcucccaugcuagaca

SEQ ID NO: 49901 - RNA, 20 nt, Artificial Sequence
  CIITA targeting sequence
caugcuagacaggaaccccu

SEQ ID NO: 49902 - RNA, 20 nt, Artificial Sequence
  CIITA targeting sequence
agcaugggagcccaaagaag

SEQ ID NO: 49903 - RNA, 20 nt, Artificial Sequence
  CIITA targeting sequence
ugucuagcaugggagcccaa

SEQ ID NO: 49904 - RNA, 20 nt, Artificial Sequence
  CIITA targeting sequence
gggguuccugucuagcaugg

SEQ ID NO: 49905 - RNA, 20 nt, Artificial Sequence
  CIITA targeting sequence
cucagggguuccugucuagc

SEQ ID NO: 49906 - RNA, 20 nt, Artificial Sequence
  CIITA targeting sequence
uacccaucucugugguccuc

SEQ ID NO: 49907 - RNA, 20 nt, Artificial Sequence
  CIITA targeting sequence
cugugguccucuuugccaag

SEQ ID NO: 49908 - RNA, 20 nt, Artificial Sequence
  CIITA targeting sequence
gugguccucuuugccaagca

SEQ ID NO: 49909 - RNA, 20 nt, Artificial Sequence
  CIITA targeting sequence
ucuuugccaagcagagucca

SEQ ID NO: 49910 - RNA, 20 nt, Artificial Sequence
  CIITA targeting sequence
uugccaagcagaguccagca

SEQ ID NO: 49911 - RNA, 20 nt, Artificial Sequence
  CIITA targeting sequence
gcuuggcaaagaggaccaca

SEQ ID NO: 49912 - RNA, 20 nt, Artificial Sequence
  CIITA targeting sequence
agcacccccagaaauguuug

SEQ ID NO: 49913 - RNA, 20 nt, Artificial Sequence
  CIITA targeting sequence
gggggugcuggacucugcuu

SEQ ID NO: 49914 - RNA, 20 nt, Artificial Sequence
  CIITA targeting sequence
aacauuucugggggugcugg

SEQ ID NO: 49915 - RNA, 20 nt, Artificial Sequence
  CIITA targeting sequence
uucaaacauuucugggggug

SEQ ID NO: 49916 - RNA, 20 nt, Artificial Sequence
  CIITA targeting sequence
gaggcagugaugaaugggug

SEQ ID NO: 49917 - RNA, 20 nt, Artificial Sequence
  CIITA targeting sequence
gacuuuucauucaaacauuu

SEQ ID NO: 49918 - RNA, 20 nt, Artificial Sequence
  CIITA targeting sequence
cugccucagacuuuucauuc

SEQ ID NO: 49919 - RNA, 20 nt, Artificial Sequence
  CIITA targeting sequence
ucacugccucagacuuuuca

SEQ ID NO: 49920 - RNA, 20 nt, Artificial Sequence
  CIITA targeting sequence
aucuaugaagccuuuucuuc

SEQ ID NO: 49921 - RNA, 20 nt, Artificial Sequence
  CIITA targeting sequence
augaagccuuuucuucccca

SEQ ID NO: 49922 - RNA, 20 nt, Artificial Sequence
  CIITA targeting sequence
uagauggaaccgguacaccc

SEQ ID NO: 49923 - RNA, 20 nt, Artificial Sequence
  CIITA targeting sequence
uccccacaacuggccuaugu

SEQ ID NO: 49924 - RNA, 20 nt, Artificial Sequence
  CIITA targeting sequence
ccacaacuggccuaugucgg

SEQ ID NO: 49925 - RNA, 20 nt, Artificial Sequence
  CIITA targeting sequence
gaggagaaucuggguuggau

SEQ ID NO: 49926 - RNA, 20 nt, Artificial Sequence
  CIITA targeting sequence
gacauaggccaguugugggg

SEQ ID NO: 49927 - RNA, 20 nt, Artificial Sequence
  CIITA targeting sequence
uccgacauaggccaguugug

SEQ ID NO: 49928 - RNA, 20 nt, Artificial Sequence
  CIITA targeting sequence
ccuccgacauaggccaguug

SEQ ID NO: 49929 - RNA, 20 nt, Artificial Sequence
  CIITA targeting sequence
ggguuggauguuagcaggag

SEQ ID NO: 49930 - RNA, 20 nt, Artificial Sequence
  CIITA targeting sequence
aacccagauucuccuccgac

SEQ ID NO: 49931 - RNA, 20 nt, Artificial Sequence
  CIITA targeting sequence
ugcuaacauccaacccagau

SEQ ID NO: 49932 - RNA, 20 nt, Artificial Sequence
  CIITA targeting sequence
ccugcuaacauccaacccag

SEQ ID NO: 49933 - RNA, 20 nt, Artificial Sequence
  CIITA targeting sequence
cuccugcuaacauccaaccc

SEQ ID NO: 49934 - RNA, 20 nt, Artificial Sequence
  CIITA targeting sequence
uugcuuagaagagccuugaa

SEQ ID NO: 49935 - RNA, 20 nt, Artificial Sequence
  CIITA targeting sequence
aagcaaggaggcauucucuc

SEQ ID NO: 49936 - RNA, 20 nt, Artificial Sequence
  CIITA targeting sequence
ucuaagcaaggaggcauucu

SEQ ID NO: 49937 - RNA, 20 nt, Artificial Sequence
  CIITA targeting sequence
aggcucuucuaagcaaggag

SEQ ID NO: 49938 - RNA, 20 nt, Artificial Sequence
  CIITA targeting sequence
gauccauuugaccagaagag

SEQ ID NO: 49939 - RNA, 20 nt, Artificial Sequence
  CIITA targeting sequence
gagccuggcauucaaggcuc

SEQ ID NO: 49940 - RNA, 20 nt, Artificial Sequence
  CIITA targeting sequence
auuugaccagaagagcuccu

SEQ ID NO: 49941 - RNA, 20 nt, Artificial Sequence
  CIITA targeting sequence
aauggaucugagccuggcau

SEQ ID NO: 49942 - RNA, 20 nt, Artificial Sequence
  CIITA targeting sequence
ggucaaauggaucugagccu

SEQ ID NO: 49943 - RNA, 20 nt, Artificial Sequence
  CIITA targeting sequence
ucuggucaaauggaucugag

SEQ ID NO: 49944 - RNA, 20 nt, Artificial Sequence
  CIITA targeting sequence
uugaggucuggccagcaucu

SEQ ID NO: 49945 - RNA, 20 nt, Artificial Sequence
  CIITA targeting sequence
aggagcucuucuggucaaau

SEQ ID NO: 49946 - RNA, 20 nt, Artificial Sequence
  CIITA targeting sequence
ggccagcaucuguggguacc

SEQ ID NO: 49947 - RNA, 20 nt, Artificial Sequence
  CIITA targeting sequence
guggguaccaggauccccca

SEQ ID NO: 49948 - RNA, 20 nt, Artificial Sequence
  CIITA targeting sequence
ugguacccacagaugcuggc

SEQ ID NO: 49949 - RNA, 20 nt, Artificial Sequence
  CIITA targeting sequence
cccacagauguguguggcac

SEQ ID NO: 49950 - RNA, 20 nt, Artificial Sequence
  CIITA targeting sequence
gugggggauccugguaccca

SEQ ID NO: 49951 - RNA, 20 nt, Artificial Sequence
  CIITA targeting sequence
gugggugccacacacaucug

SEQ ID NO: 49952 - RNA, 20 nt, Artificial Sequence
  CIITA targeting sequence
cuagcaguguuaguaauaua

SEQ ID NO: 49953 - RNA, 20 nt, Artificial Sequence
  CIITA targeting sequence
agcaguguuaguaauauaga

SEQ ID NO: 49954 - RNA, 20 nt, Artificial Sequence
  CIITA targeting sequence
auauuacuaacacugcuaga

SEQ ID NO: 49955 - RNA, 20 nt, Artificial Sequence
  CIITA targeting sequence
cagaggugaguuuuguuuug

SEQ ID NO: 49956 - RNA, 20 nt, Artificial Sequence
  CIITA targeting sequence
gggaucuauauuacuaacac

SEQ ID NO: 49957 - RNA, 20 nt, Artificial Sequence
  CIITA targeting sequence
ccucugggaucuauauuacu

SEQ ID NO: 49958 - RNA, 20 nt, Artificial Sequence
  CIITA targeting sequence
aaaaaaccccccaaaacaaa

SEQ ID NO: 49959 - RNA, 20 nt, Artificial Sequence
  CIITA targeting sequence
caaaaaaaccccccaaaaca

SEQ ID NO: 49960 - RNA, 20 nt, Artificial Sequence
  CIITA targeting sequence
cacucugucgcccaggcugg

SEQ ID NO: 49961 - RNA, 20 nt, Artificial Sequence
  CIITA targeting sequence
cucugucgcccaggcuggag

SEQ ID NO: 49962 - RNA, 20 nt, Artificial Sequence
  CIITA targeting sequence
gucgcccaggcuggaguaca

SEQ ID NO: 49963 - RNA, 20 nt, Artificial Sequence
  CIITA targeting sequence
cccaggcuggaguacagugg

SEQ ID NO: 49964 - RNA, 20 nt, Artificial Sequence
  CIITA targeting sequence
agccugggcgacagagugag

SEQ ID NO: 49965 - RNA, 20 nt, Artificial Sequence
  CIITA targeting sequence
cagcuuacugcaaccucugc

SEQ ID NO: 49966 - RNA, 20 nt, Artificial Sequence
  CIITA targeting sequence
gcuuacugcaaccucugccu

SEQ ID NO: 49967 - RNA, 20 nt, Artificial Sequence
  CIITA targeting sequence
gccuccugggcucaagcagu

SEQ ID NO: 49968 - RNA, 20 nt, Artificial Sequence
  CIITA targeting sequence
ugggcucaagcaguccuccu

SEQ ID NO: 49969 - RNA, 20 nt, Artificial Sequence
  CIITA targeting sequence
agcaguccuccugccucagc

SEQ ID NO: 49970 - RNA, 20 nt, Artificial Sequence
  CIITA targeting sequence
uccugccucagccuuccaag

SEQ ID NO: 49971 - RNA, 20 nt, Artificial Sequence
  CIITA targeting sequence
ugccucagccuuccaaguac

SEQ ID NO: 49972 - RNA, 20 nt, Artificial Sequence
  CIITA targeting sequence
gccuuccaaguaccugggac

SEQ ID NO: 49973 - RNA, 20 nt, Artificial Sequence
  CIITA targeting sequence
aaguaccugggacuacagcc

SEQ ID NO: 49974 - RNA, 20 nt, Artificial Sequence
  CIITA targeting sequence
cagguacuuggaaggcugag

SEQ ID NO: 49975 - RNA, 20 nt, Artificial Sequence
  CIITA targeting sequence
cccuaggagucauagagaug

SEQ ID NO: 49976 - RNA, 20 nt, Artificial Sequence
  CIITA targeting sequence
cuaggagucauagagauggg

SEQ ID NO: 49977 - RNA, 20 nt, Artificial Sequence
  CIITA targeting sequence
uagggagauaauuuuaauaa

SEQ ID NO: 49978 - RNA, 20 nt, Artificial Sequence
  CIITA targeting sequence
uagagauggggucucacuau

SEQ ID NO: 49979 - RNA, 20 nt, Artificial Sequence
  CIITA targeting sequence
augacuccuagggagauaau

SEQ ID NO: 49980 - RNA, 20 nt, Artificial Sequence
  CIITA targeting sequence
cuaugacuccuagggagaua

SEQ ID NO: 49981 - RNA, 20 nt, Artificial Sequence
  CIITA targeting sequence
cacuauauugcccaggcugu

SEQ ID NO: 49982 - RNA, 20 nt, Artificial Sequence
  CIITA targeting sequence
cuauauugcccaggcuguuu

SEQ ID NO: 49983 - RNA, 20 nt, Artificial Sequence
  CIITA targeting sequence
aacucugagcucaagcaauc

SEQ ID NO: 49984 - RNA, 20 nt, Artificial Sequence
  CIITA targeting sequence
gagcucaagcaauccuccca

SEQ ID NO: 49985 - RNA, 20 nt, Artificial Sequence
  CIITA targeting sequence
gaguuugaaaacagccuggg

SEQ ID NO: 49986 - RNA, 20 nt, Artificial Sequence
  CIITA targeting sequence
agcaauccucccaccucagc

SEQ ID NO: 49987 - RNA, 20 nt, Artificial Sequence
  CIITA targeting sequence
ucccaccucagccucccaaa

SEQ ID NO: 49988 - RNA, 20 nt, Artificial Sequence
  CIITA targeting sequence
caccucagccucccaaagga

SEQ ID NO: 49989 - RNA, 20 nt, Artificial Sequence
  CIITA targeting sequence
gccucccaaaggaugggauu

SEQ ID NO: 49990 - RNA, 20 nt, Artificial Sequence
  CIITA targeting sequence
caaaggaugggauuacaggu

SEQ ID NO: 49991 - RNA, 20 nt, Artificial Sequence
  CIITA targeting sequence
uuugggaggcugagguggga

SEQ ID NO: 49992 - RNA, 20 nt, Artificial Sequence
  CIITA targeting sequence
cauccuuugggaggcugagg

SEQ ID NO: 49993 - RNA, 20 nt, Artificial Sequence
  CIITA targeting sequence
cagagguuuuaacauauucu

SEQ ID NO: 49994 - RNA, 20 nt, Artificial Sequence
  CIITA targeting sequence
gggauaugcuggguguggug

SEQ ID NO: 49995 - RNA, 20 nt, Artificial Sequence
  CIITA targeting sequence
cuagacuauguccucugccu

SEQ ID NO: 49996 - RNA, 20 nt, Artificial Sequence
  CIITA targeting sequence
agacuauguccucugccugg

SEQ ID NO: 49997 - RNA, 20 nt, Artificial Sequence
  CIITA targeting sequence
agagaauauguuaaaaccuc

SEQ ID NO: 49998 - RNA, 20 nt, Artificial Sequence
  CIITA targeting sequence
ucugccuggggaccucaccc

SEQ ID NO: 49999 - RNA, 20 nt, Artificial Sequence
  CIITA targeting sequence
gccuggggaccucacccccu

SEQ ID NO: 50000 - RNA, 20 nt, Artificial Sequence
  CIITA targeting sequence
ccaggcagaggacauagucu

SEQ ID NO: 50001 - RNA, 20 nt, Artificial Sequence
  CIITA targeting sequence
cccccuaaggaaggagaaua

SEQ ID NO: 50002 - RNA, 20 nt, Artificial Sequence
  CIITA targeting sequence
uuagggggugagguccccag

SEQ ID NO: 50003 - RNA, 20 nt, Artificial Sequence
  CIITA targeting sequence
uuccuuagggggugaggucc

SEQ ID NO: 50004 - RNA, 20 nt, Artificial Sequence
  CIITA targeting sequence
ccuuccuuagggggugaggu

SEQ ID NO: 50005 - RNA, 20 nt, Artificial Sequence
  CIITA targeting sequence
uggcccaggguauucuccuu

SEQ ID NO: 50006 - RNA, 20 nt, Artificial Sequence
  CIITA targeting sequence
gcucucuggaauacccuugu

SEQ ID NO: 50007 - RNA, 20 nt, Artificial Sequence
  CIITA targeting sequence
cuggaauacccuuguguacu

SEQ ID NO: 50008 - RNA, 20 nt, Artificial Sequence
  CIITA targeting sequence
ggaauacccuuguguacuuu

SEQ ID NO: 50009 - RNA, 20 nt, Artificial Sequence
  CIITA targeting sequence
agagagcagauccuggccca

SEQ ID NO: 50010 - RNA, 20 nt, Artificial Sequence
  CIITA targeting sequence
gaugaggugccuuacagagg

SEQ ID NO: 50011 - RNA, 20 nt, Artificial Sequence
  CIITA targeting sequence
gaaaaguacacaaggguauu

SEQ ID NO: 50012 - RNA, 20 nt, Artificial Sequence
  CIITA targeting sequence
ucagaaaaguacacaagggu

SEQ ID NO: 50013 - RNA, 20 nt, Artificial Sequence
  CIITA targeting sequence
guaaggcaccucaucagaaa

SEQ ID NO: 50014 - RNA, 20 nt, Artificial Sequence
  CIITA targeting sequence
ucuguaaggcaccucaucag

SEQ ID NO: 50015 - RNA, 20 nt, Artificial Sequence
  CIITA targeting sequence
aagggaaagagaagauguag

SEQ ID NO: 50016 - RNA, 20 nt, Artificial Sequence
  CIITA targeting sequence
cuuggauuuccucuguaagg

SEQ ID NO: 50017 - RNA, 20 nt, Artificial Sequence
  CIITA targeting sequence
uucccuuggauuuccucugu

SEQ ID NO: 50018 - RNA, 20 nt, Artificial Sequence
  CIITA targeting sequence
cuuucccuuggauuuccucu

SEQ ID NO: 50019 - RNA, 20 nt, Artificial Sequence
  CIITA targeting sequence
ucucuuucccuuggauuucc

SEQ ID NO: 50020 - RNA, 20 nt, Artificial Sequence
  CIITA targeting sequence
ucaagaacuucucuccagag

SEQ ID NO: 50021 - RNA, 20 nt, Artificial Sequence
  CIITA targeting sequence
agaacuucucuccagaggga

SEQ ID NO: 50022 - RNA, 20 nt, Artificial Sequence
  CIITA targeting sequence
ugaagauggggcuacaucuu

SEQ ID NO: 50023 - RNA, 20 nt, Artificial Sequence
  CIITA targeting sequence
cuccagagggaggaaggaga

SEQ ID NO: 50024 - RNA, 20 nt, Artificial Sequence
  CIITA targeting sequence
ccagagggaggaaggagagg

SEQ ID NO: 50025 - RNA, 20 nt, Artificial Sequence
  CIITA targeting sequence
agagggaggaaggagaggug

SEQ ID NO: 50026 - RNA, 20 nt, Artificial Sequence
  CIITA targeting sequence
ggagagaaguucuugaagau

SEQ ID NO: 50027 - RNA, 20 nt, Artificial Sequence
  CIITA targeting sequence
cucuggagagaaguucuuga

SEQ ID NO: 50028 - RNA, 20 nt, Artificial Sequence
  CIITA targeting sequence
ucccucuggagagaaguucu

SEQ ID NO: 50029 - RNA, 20 nt, Artificial Sequence
  CIITA targeting sequence
uuccucccucuggagagaag

SEQ ID NO: 50030 - RNA, 20 nt, Artificial Sequence
  CIITA targeting sequence
ccuuccucccucuggagaga

SEQ ID NO: 50031 - RNA, 20 nt, Artificial Sequence
  CIITA targeting sequence
ugguaugggcccaccucucc

SEQ ID NO: 50032 - RNA, 20 nt, Artificial Sequence
  CIITA targeting sequence
accuucgugguaugggccca

SEQ ID NO: 50033 - RNA, 20 nt, Artificial Sequence
  CIITA targeting sequence
ccaccuucgugguaugggcc

SEQ ID NO: 50034 - RNA, 20 nt, Artificial Sequence
  CIITA targeting sequence
caagcccucucugcacccca

SEQ ID NO: 50035 - RNA, 20 nt, Artificial Sequence
  CIITA targeting sequence
cugcaccccagcuuacuugu

SEQ ID NO: 50036 - RNA, 20 nt, Artificial Sequence
  CIITA targeting sequence
gcaccccagcuuacuuguuc

SEQ ID NO: 50037 - RNA, 20 nt, Artificial Sequence
  CIITA targeting sequence
caacagcauuccuacaaagu

SEQ ID NO: 50038 - RNA, 20 nt, Artificial Sequence
  CIITA targeting sequence
uacaaaguagggguguccuc

SEQ ID NO: 50039 - RNA, 20 nt, Artificial Sequence
  CIITA targeting sequence
ucauuuuucagauaaggaaa

SEQ ID NO: 50040 - RNA, 20 nt, Artificial Sequence
  CIITA targeting sequence
uuuuucagauaaggaaacag

SEQ ID NO: 50041 - RNA, 20 nt, Artificial Sequence
  CIITA targeting sequence
gauaaggaaacagccucuga

SEQ ID NO: 50042 - RNA, 20 nt, Artificial Sequence
  CIITA targeting sequence
gaaaaaugaggacaccccua

SEQ ID NO: 50043 - RNA, 20 nt, Artificial Sequence
  CIITA targeting sequence
uuaucugaaaaaugaggaca

SEQ ID NO: 50044 - RNA, 20 nt, Artificial Sequence
  CIITA targeting sequence
gaagggucacccaguguaag

SEQ ID NO: 50045 - RNA, 20 nt, Artificial Sequence
  CIITA targeting sequence
gaggcuguuuccuuaucuga

SEQ ID NO: 50046 - RNA, 20 nt, Artificial Sequence
  CIITA targeting sequence
cccaguguaaggaugcaucu

SEQ ID NO: 50047 - RNA, 20 nt, Artificial Sequence
  CIITA targeting sequence
uuacacugggugacccuuca

SEQ ID NO: 50048 - RNA, 20 nt, Artificial Sequence
  CIITA targeting sequence
gccuucuucaucccuguagc

SEQ ID NO: 50049 - RNA, 20 nt, Artificial Sequence
  CIITA targeting sequence
ucaucccuguagcccaguac

SEQ ID NO: 50050 - RNA, 20 nt, Artificial Sequence
  CIITA targeting sequence
ucccuguagcccaguacccg

SEQ ID NO: 50051 - RNA, 20 nt, Artificial Sequence
  CIITA targeting sequence
cuguagcccaguacccgaca

SEQ ID NO: 50052 - RNA, 20 nt, Artificial Sequence
  CIITA targeting sequence
gguacugggcuacagggaug

SEQ ID NO: 50053 - RNA, 20 nt, Artificial Sequence
  CIITA targeting sequence
accccauuugugccuagggc

SEQ ID NO: 50054 - RNA, 20 nt, Artificial Sequence
  CIITA targeting sequence
cuaccccauuugugccuagg

SEQ ID NO: 50055 - RNA, 20 nt, Artificial Sequence
  CIITA targeting sequence
cucuaccccauuugugccua

SEQ ID NO: 50056 - RNA, 20 nt, Artificial Sequence
  CIITA targeting sequence
gggucucucuaccccauuug

SEQ ID NO: 50057 - RNA, 20 nt, Artificial Sequence
  CIITA targeting sequence
uguggaagguccagagcaga

SEQ ID NO: 50058 - RNA, 20 nt, Artificial Sequence
  CIITA targeting sequence
acaggauguggucagggucu

SEQ ID NO: 50059 - RNA, 20 nt, Artificial Sequence
  CIITA targeting sequence
agagcagagccaucacagag

SEQ ID NO: 50060 - RNA, 20 nt, Artificial Sequence
  CIITA targeting sequence
ggaccuuccacaggaugugg

SEQ ID NO: 50061 - RNA, 20 nt, Artificial Sequence
  CIITA targeting sequence
gcucuggaccuuccacagga

SEQ ID NO: 50062 - RNA, 20 nt, Artificial Sequence
  CIITA targeting sequence
cagagggcuuccgaagacca

SEQ ID NO: 50063 - RNA, 20 nt, Artificial Sequence
  CIITA targeting sequence
gugauggcucugcucuggac

SEQ ID NO: 50064 - RNA, 20 nt, Artificial Sequence
  CIITA targeting sequence
gaagaccaggauacccuugu

SEQ ID NO: 50065 - RNA, 20 nt, Artificial Sequence
  CIITA targeting sequence
gaagcccucugugauggcuc

SEQ ID NO: 50066 - RNA, 20 nt, Artificial Sequence
  CIITA targeting sequence
ucggaagcccucugugaugg

SEQ ID NO: 50067 - RNA, 20 nt, Artificial Sequence
  CIITA targeting sequence
uggucuucggaagcccucug

SEQ ID NO: 50068 - RNA, 20 nt, Artificial Sequence
  CIITA targeting sequence
ugggcugcugggcugcugaa

SEQ ID NO: 50069 - RNA, 20 nt, Artificial Sequence
  CIITA targeting sequence
gcagcccagcagcccaggaa

SEQ ID NO: 50070 - RNA, 20 nt, Artificial Sequence
  CIITA targeting sequence
ccgcuguucagcagcccagc

SEQ ID NO: 50071 - RNA, 20 nt, Artificial Sequence
  CIITA targeting sequence
uccccgcuguucagcagccc

SEQ ID NO: 50072 - RNA, 20 nt, Artificial Sequence
  CIITA targeting sequence
ucuuccccgcuguucagcag

SEQ ID NO: 50073 - RNA, 20 nt, Artificial Sequence
  CIITA targeting sequence
cacagcuccucuuccccgcu

SEQ ID NO: 50074 - RNA, 20 nt, Artificial Sequence
  CIITA targeting sequence
agguucacacagcuccucuu

SEQ ID NO: 50075 - RNA, 20 nt, Artificial Sequence
  CIITA targeting sequence
augugacuuuaucuggcugc

SEQ ID NO: 50076 - RNA, 20 nt, Artificial Sequence
  CIITA targeting sequence
cauggaaucuagguucacac

SEQ ID NO: 50077 - RNA, 20 nt, Artificial Sequence
  CIITA targeting sequence
ggcugcauaaugagcuuaag

SEQ ID NO: 50078 - RNA, 20 nt, Artificial Sequence
  CIITA targeting sequence
uuaugcagccagauaaaguc

SEQ ID NO: 50079 - RNA, 20 nt, Artificial Sequence
  CIITA targeting sequence
gaucuuuucuuggaaaucuc

SEQ ID NO: 50080 - RNA, 20 nt, Artificial Sequence
  CIITA targeting sequence
gaauacuuaagcucauuaug

SEQ ID NO: 50081 - RNA, 20 nt, Artificial Sequence
  CIITA targeting sequence
uuucuuggaaaucucaagua

SEQ ID NO: 50082 - RNA, 20 nt, Artificial Sequence
  CIITA targeting sequence
uggaaaucucaaguauucca

SEQ ID NO: 50083 - RNA, 20 nt, Artificial Sequence
  CIITA targeting sequence
aagaaaagaucugaauacuu

SEQ ID NO: 50084 - RNA, 20 nt, Artificial Sequence
  CIITA targeting sequence
caaguauuccauuuggcugc

SEQ ID NO: 50085 - RNA, 20 nt, Artificial Sequence
  CIITA targeting sequence
aguauuccauuuggcugccu

SEQ ID NO: 50086 - RNA, 20 nt, Artificial Sequence
  CIITA targeting sequence
auuuggcugccucacagagu

SEQ ID NO: 50087 - RNA, 20 nt, Artificial Sequence
  CIITA targeting sequence
cagaguuaggcaauuuuauu

SEQ ID NO: 50088 - RNA, 20 nt, Artificial Sequence
  CIITA targeting sequence
gugaggcagccaaauggaau

SEQ ID NO: 50089 - RNA, 20 nt, Artificial Sequence
  CIITA targeting sequence
ugcuaaacagggccauuuuc

SEQ ID NO: 50090 - RNA, 20 nt, Artificial Sequence
  CIITA targeting sequence
gagaggaaauuaugcaaugu

SEQ ID NO: 50091 - RNA, 20 nt, Artificial Sequence
  CIITA targeting sequence
gaaaauggcccuguuuagca

SEQ ID NO: 50092 - RNA, 20 nt, Artificial Sequence
  CIITA targeting sequence
cugaaaauggcccuguuuag

SEQ ID NO: 50093 - RNA, 20 nt, Artificial Sequence
  CIITA targeting sequence
ucucugaaaauggcccuguu

SEQ ID NO: 50094 - RNA, 20 nt, Artificial Sequence
  CIITA targeting sequence
gagagcagagauaagugugg

SEQ ID NO: 50095 - RNA, 20 nt, Artificial Sequence
  CIITA targeting sequence
gaaugccacauuugcauagu

SEQ ID NO: 50096 - RNA, 20 nt, Artificial Sequence
  CIITA targeting sequence
cggaaugccacauuugcaua

SEQ ID NO: 50097 - RNA, 20 nt, Artificial Sequence
  CIITA targeting sequence
gcucucggaaugccacauuu

SEQ ID NO: 50098 - RNA, 20 nt, Artificial Sequence
  CIITA targeting sequence
cugcucucggaaugccacau

SEQ ID NO: 50099 - RNA, 20 nt, Artificial Sequence
  CIITA targeting sequence
ccgaugcauuguaagaugag

SEQ ID NO: 50100 - RNA, 20 nt, Artificial Sequence
  CIITA targeting sequence
gugaccacacuuaucucugc

SEQ ID NO: 50101 - RNA, 20 nt, Artificial Sequence
  CIITA targeting sequence
uacaaugcaucggugaccac

SEQ ID NO: 50102 - RNA, 20 nt, Artificial Sequence
  CIITA targeting sequence
ucuuacaaugcaucggugac

SEQ ID NO: 50103 - RNA, 20 nt, Artificial Sequence
  CIITA targeting sequence
caucuuacaaugcaucggug

SEQ ID NO: 50104 - RNA, 20 nt, Artificial Sequence
  CIITA targeting sequence
ugucucuggcagcugggugu

SEQ ID NO: 50105 - RNA, 20 nt, Artificial Sequence
  CIITA targeting sequence
cuggcagcugggugucacuu

SEQ ID NO: 50106 - RNA, 20 nt, Artificial Sequence
  CIITA targeting sequence
ggcagcugggugucacuuga

SEQ ID NO: 50107 - RNA, 20 nt, Artificial Sequence
  CIITA targeting sequence
cuugauaaggggauaugcca

SEQ ID NO: 50108 - RNA, 20 nt, Artificial Sequence
  CIITA targeting sequence
agugacacccagcugccaga

SEQ ID NO: 50109 - RNA, 20 nt, Artificial Sequence
  CIITA targeting sequence
ccuuaucaagugacacccag

SEQ ID NO: 50110 - RNA, 20 nt, Artificial Sequence
  CIITA targeting sequence
ggcauauccccuuaucaagu

SEQ ID NO: 50111 - RNA, 20 nt, Artificial Sequence
  CIITA targeting sequence
aaguacagucuggcauaucc

SEQ ID NO: 50112 - RNA, 20 nt, Artificial Sequence
  CIITA targeting sequence
cuuggacucgguuucuggua

SEQ ID NO: 50113 - RNA, 20 nt, Artificial Sequence
  CIITA targeting sequence
aagggagcagcaguuccaag

SEQ ID NO: 50114 - RNA, 20 nt, Artificial Sequence
  CIITA targeting sequence
guuucugguaauuguguuuu

SEQ ID NO: 50115 - RNA, 20 nt, Artificial Sequence
  CIITA targeting sequence
gguaauuguguuuucaccaa

SEQ ID NO: 50116 - RNA, 20 nt, Artificial Sequence
  CIITA targeting sequence
ccaaguugucaagcugugaa

SEQ ID NO: 50117 - RNA, 20 nt, Artificial Sequence
  CIITA targeting sequence
agcugugaacugcacguauu

SEQ ID NO: 50118 - RNA, 20 nt, Artificial Sequence
  CIITA targeting sequence
cagcuugacaacuuggugaa

SEQ ID NO: 50119 - RNA, 20 nt, Artificial Sequence
  CIITA targeting sequence
auacgugcaguucacagcuu

SEQ ID NO: 50120 - RNA, 20 nt, Artificial Sequence
  CIITA targeting sequence
ucaauacgugcaguucacag

SEQ ID NO: 50121 - RNA, 20 nt, Artificial Sequence
  CIITA targeting sequence
ucuucaauacgugcaguuca

SEQ ID NO: 50122 - RNA, 20 nt, Artificial Sequence
  CIITA targeting sequence
ucuucuucaauacgugcagu

SEQ ID NO: 50123 - RNA, 20 nt, Artificial Sequence
  CIITA targeting sequence
uuguuccucuucuucaauac

SEQ ID NO: 50124 - RNA, 20 nt, Artificial Sequence
  CIITA targeting sequence
cuccuuguuccucuucuuca

SEQ ID NO: 50125 - RNA, 20 nt, Artificial Sequence
  CIITA targeting sequence
uccuuaaguagacuucagca

SEQ ID NO: 50126 - RNA, 20 nt, Artificial Sequence
  CIITA targeting sequence
uuaaguagacuucagcaguc

SEQ ID NO: 50127 - RNA, 20 nt, Artificial Sequence
  CIITA targeting sequence
acuuaaggaugagcaacuug

SEQ ID NO: 50128 - RNA, 20 nt, Artificial Sequence
  CIITA targeting sequence
gcagucagagaggcugcccc

SEQ ID NO: 50129 - RNA, 20 nt, Artificial Sequence
  CIITA targeting sequence
gagaggcugcccccauacau

SEQ ID NO: 50130 - RNA, 20 nt, Artificial Sequence
  CIITA targeting sequence
gacugcugaagucuacuuaa

SEQ ID NO: 50131 - RNA, 20 nt, Artificial Sequence
  CIITA targeting sequence
cugacugcugaagucuacuu

SEQ ID NO: 50132 - RNA, 20 nt, Artificial Sequence
  CIITA targeting sequence
ggacacaugggaacaaggag

SEQ ID NO: 50133 - RNA, 20 nt, Artificial Sequence
  CIITA targeting sequence
agaacauguaugggggcagc

SEQ ID NO: 50134 - RNA, 20 nt, Artificial Sequence
  CIITA targeting sequence
cauguguccagaacauguau

SEQ ID NO: 50135 - RNA, 20 nt, Artificial Sequence
  CIITA targeting sequence
uuguucccauguguccagaa

SEQ ID NO: 50136 - RNA, 20 nt, Artificial Sequence
  CIITA targeting sequence
cauccuccauucucccaaga

SEQ ID NO: 50137 - RNA, 20 nt, Artificial Sequence
  CIITA targeting sequence
uccuccauucucccaagaag

SEQ ID NO: 50138 - RNA, 20 nt, Artificial Sequence
  CIITA targeting sequence
uccauucucccaagaagagu

SEQ ID NO: 50139 - RNA, 20 nt, Artificial Sequence
  CIITA targeting sequence
auucucccaagaagagucuu

SEQ ID NO: 50140 - RNA, 20 nt, Artificial Sequence
  CIITA targeting sequence
cccaagaagagucuuaaaau

SEQ ID NO: 50141 - RNA, 20 nt, Artificial Sequence
  CIITA targeting sequence
caagaagagucuuaaaauuu

SEQ ID NO: 50142 - RNA, 20 nt, Artificial Sequence
  CIITA targeting sequence
ugggagaauggaggaugaga

SEQ ID NO: 50143 - RNA, 20 nt, Artificial Sequence
  CIITA targeting sequence
ucuugggagaauggaggaug

SEQ ID NO: 50144 - RNA, 20 nt, Artificial Sequence
  CIITA targeting sequence
uaaaauuugacacgggggaa

SEQ ID NO: 50145 - RNA, 20 nt, Artificial Sequence
  CIITA targeting sequence
aauuuuaagacucuucuugg

SEQ ID NO: 50146 - RNA, 20 nt, Artificial Sequence
  CIITA targeting sequence
cccgugucaaauuuuaagac

SEQ ID NO: 50147 - RNA, 20 nt, Artificial Sequence
  CIITA targeting sequence
uucccccgugucaaauuuua

SEQ ID NO: 50148 - RNA, 20 nt, Artificial Sequence
  CIITA targeting sequence
ucuuucccccgugucaaauu

SEQ ID NO: 50149 - RNA, 20 nt, Artificial Sequence
  CIITA targeting sequence
ucaucuuucccccgugucaa

SEQ ID NO: 50150 - RNA, 20 nt, Artificial Sequence
  CIITA targeting sequence
uggccacugugaaaaccagu

SEQ ID NO: 50151 - RNA, 20 nt, Artificial Sequence
  CIITA targeting sequence
caguggccaggaaaaccagu

SEQ ID NO: 50152 - RNA, 20 nt, Artificial Sequence
  CIITA targeting sequence
ccucauuuuacuagacaugg

SEQ ID NO: 50153 - RNA, 20 nt, Artificial Sequence
  CIITA targeting sequence
uuuuacuagacauggcaugu

SEQ ID NO: 50154 - RNA, 20 nt, Artificial Sequence
  CIITA targeting sequence
aguaaaaugaggugacuggu

SEQ ID NO: 50155 - RNA, 20 nt, Artificial Sequence
  CIITA targeting sequence
uacugagagaaaggaaguag

SEQ ID NO: 50156 - RNA, 20 nt, Artificial Sequence
  CIITA targeting sequence
guaugaaaggcacaugccau

SEQ ID NO: 50157 - RNA, 20 nt, Artificial Sequence
  CIITA targeting sequence
caguaugaaaggcacaugcc

SEQ ID NO: 50158 - RNA, 20 nt, Artificial Sequence
  CIITA targeting sequence
cucaguaugaaaggcacaug

SEQ ID NO: 50159 - RNA, 20 nt, Artificial Sequence
  CIITA targeting sequence
uuucucucaguaugaaaggc

SEQ ID NO: 50160 - RNA, 20 nt, Artificial Sequence
  CIITA targeting sequence
acagcuacuuccuuucucuc

SEQ ID NO: 50161 - RNA, 20 nt, Artificial Sequence
  CIITA targeting sequence
aaaggugggguuuuccacag

SEQ ID NO: 50162 - RNA, 20 nt, Artificial Sequence
  CIITA targeting sequence
gcuuccaaaggugggguuuu

SEQ ID NO: 50163 - RNA, 20 nt, Artificial Sequence
  CIITA targeting sequence
gucugcuuccaaaggugggg

SEQ ID NO: 50164 - RNA, 20 nt, Artificial Sequence
  CIITA targeting sequence
gcucugucugcuuccaaagg

SEQ ID NO: 50165 - RNA, 20 nt, Artificial Sequence
  CIITA targeting sequence
cccagccuguggguaccuga

SEQ ID NO: 50166 - RNA, 20 nt, Artificial Sequence
  CIITA targeting sequence
gguacccacaggcuggggga

SEQ ID NO: 50167 - RNA, 20 nt, Artificial Sequence
  CIITA targeting sequence
cagguacccacaggcugggg

SEQ ID NO: 50168 - RNA, 20 nt, Artificial Sequence
  CIITA targeting sequence
aucucagguacccacaggcu

SEQ ID NO: 50169 - RNA, 20 nt, Artificial Sequence
  CIITA targeting sequence
ccaagccuucagcucccugc

SEQ ID NO: 50170 - RNA, 20 nt, Artificial Sequence
  CIITA targeting sequence
gcucccugccugaaaauggc

SEQ ID NO: 50171 - RNA, 20 nt, Artificial Sequence
  CIITA targeting sequence
cugccugaaaauggcacuuu

SEQ ID NO: 50172 - RNA, 20 nt, Artificial Sequence
  CIITA targeting sequence
ggcagggagcugaaggcuug

SEQ ID NO: 50173 - RNA, 20 nt, Artificial Sequence
  CIITA targeting sequence
guuaguuauugcuccugggc

SEQ ID NO: 50174 - RNA, 20 nt, Artificial Sequence
  CIITA targeting sequence
ugggccguguaccagucaca

SEQ ID NO: 50175 - RNA, 20 nt, Artificial Sequence
  CIITA targeting sequence
caaagacagccaacccuuca

SEQ ID NO: 50176 - RNA, 20 nt, Artificial Sequence
  CIITA targeting sequence
uugugacugguacacggccc

SEQ ID NO: 50177 - RNA, 20 nt, Artificial Sequence
  CIITA targeting sequence
cacagccacugcucagauag

SEQ ID NO: 50178 - RNA, 20 nt, Artificial Sequence
  CIITA targeting sequence
gauaguugcugagugagcca

SEQ ID NO: 50179 - RNA, 20 nt, Artificial Sequence
  CIITA targeting sequence
gagcaguggcugugugaagg

SEQ ID NO: 50180 - RNA, 20 nt, Artificial Sequence
  CIITA targeting sequence
gcaacuaucugagcaguggc

SEQ ID NO: 50181 - RNA, 20 nt, Artificial Sequence
  CIITA targeting sequence
cucagcaacuaucugagcag

SEQ ID NO: 50182 - RNA, 20 nt, Artificial Sequence
  CIITA targeting sequence
cuggcucacucagcaacuau

SEQ ID NO: 50183 - RNA, 20 nt, Artificial Sequence
  CIITA targeting sequence
gucacuggcucacucagcaa

SEQ ID NO: 50184 - RNA, 20 nt, Artificial Sequence
  CIITA targeting sequence
accucuaucuguaaagugag

SEQ ID NO: 50185 - RNA, 20 nt, Artificial Sequence
  CIITA targeting sequence
aucuguaaagugagcauuga

SEQ ID NO: 50186 - RNA, 20 nt, Artificial Sequence
  CIITA targeting sequence
guaaagugagcauugauaca

SEQ ID NO: 50187 - RNA, 20 nt, Artificial Sequence
  CIITA targeting sequence
cuuuacagauagagguggau

SEQ ID NO: 50188 - RNA, 20 nt, Artificial Sequence
  CIITA targeting sequence
augcucacuuuacagauaga

SEQ ID NO: 50189 - RNA, 20 nt, Artificial Sequence
  CIITA targeting sequence
ucaguggcccugagugugcu

SEQ ID NO: 50190 - RNA, 20 nt, Artificial Sequence
  CIITA targeting sequence
guggcccugagugugcuggg

SEQ ID NO: 50191 - RNA, 20 nt, Artificial Sequence
  CIITA targeting sequence
gggccacugaggacacugua

SEQ ID NO: 50192 - RNA, 20 nt, Artificial Sequence
  CIITA targeting sequence
cagcacacucagggccacug

SEQ ID NO: 50193 - RNA, 20 nt, Artificial Sequence
  CIITA targeting sequence
cccagcacacucagggccac

SEQ ID NO: 50194 - RNA, 20 nt, Artificial Sequence
  CIITA targeting sequence
ugucucccagcacacucagg

SEQ ID NO: 50195 - RNA, 20 nt, Artificial Sequence
  CIITA targeting sequence
ucaugucucccagcacacuc

SEQ ID NO: 50196 - RNA, 20 nt, Artificial Sequence
  CIITA targeting sequence
gcagaguuaagagauucugg

SEQ ID NO: 50197 - RNA, 20 nt, Artificial Sequence
  CIITA targeting sequence
gcagaaucuucaugucuccc

SEQ ID NO: 50198 - RNA, 20 nt, Artificial Sequence
  CIITA targeting sequence
uaacucugcagaaucuucau

SEQ ID NO: 50199 - RNA, 20 nt, Artificial Sequence
  CIITA targeting sequence
cuuaacucugcagaaucuuc

SEQ ID NO: 50200 - RNA, 20 nt, Artificial Sequence
  CIITA targeting sequence
ggaaagaguccuacagaggg

SEQ ID NO: 50201 - RNA, 20 nt, Artificial Sequence
  CIITA targeting sequence
agaaucucuuaacucugcag

SEQ ID NO: 50202 - RNA, 20 nt, Artificial Sequence
  CIITA targeting sequence
uuccagaaucucuuaacucu

SEQ ID NO: 50203 - RNA, 20 nt, Artificial Sequence
  CIITA targeting sequence
uacagagggcuccauccaaa

SEQ ID NO: 50204 - RNA, 20 nt, Artificial Sequence
  CIITA targeting sequence
guaggacucuuuccagaauc

SEQ ID NO: 50205 - RNA, 20 nt, Artificial Sequence
  CIITA targeting sequence
auccaaacucuuuccauuca

SEQ ID NO: 50206 - RNA, 20 nt, Artificial Sequence
  CIITA targeting sequence
aaacucuuuccauucaaauc

SEQ ID NO: 50207 - RNA, 20 nt, Artificial Sequence
  CIITA targeting sequence
uuccauucaaauccuugcua

SEQ ID NO: 50208 - RNA, 20 nt, Artificial Sequence
  CIITA targeting sequence
auucaaauccuugcuauuca

SEQ ID NO: 50209 - RNA, 20 nt, Artificial Sequence
  CIITA targeting sequence
aauccuugcuauucaacuug

SEQ ID NO: 50210 - RNA, 20 nt, Artificial Sequence
  CIITA targeting sequence
uugcuauucaacuugggaac

SEQ ID NO: 50211 - RNA, 20 nt, Artificial Sequence
  CIITA targeting sequence
acuugggaacaaaauggauc

SEQ ID NO: 50212 - RNA, 20 nt, Artificial Sequence
  CIITA targeting sequence
caaguugaauagcaaggauu

SEQ ID NO: 50213 - RNA, 20 nt, Artificial Sequence
  CIITA targeting sequence
auuuuguucccaaguugaau

SEQ ID NO: 50214 - RNA, 20 nt, Artificial Sequence
  CIITA targeting sequence
ucacaaugauaggauccugu

SEQ ID NO: 50215 - RNA, 20 nt, Artificial Sequence
  CIITA targeting sequence
caaugauaggauccuguagu

SEQ ID NO: 50216 - RNA, 20 nt, Artificial Sequence
  CIITA targeting sequence
uugugaagauccauuuuguu

SEQ ID NO: 50217 - RNA, 20 nt, Artificial Sequence
  CIITA targeting sequence
uaucauugugaagauccauu

SEQ ID NO: 50218 - RNA, 20 nt, Artificial Sequence
  CIITA targeting sequence
uguagucaucacacaaaagu

SEQ ID NO: 50219 - RNA, 20 nt, Artificial Sequence
  CIITA targeting sequence
ucacacaaaagugauauaaa

SEQ ID NO: 50220 - RNA, 20 nt, Artificial Sequence
  CIITA targeting sequence
cacaaaagugauauaaagga

SEQ ID NO: 50221 - RNA, 20 nt, Artificial Sequence
  CIITA targeting sequence
cuuuugugugaugacuacag

SEQ ID NO: 50222 - RNA, 20 nt, Artificial Sequence
  CIITA targeting sequence
uuuauaucacuuuuguguga

SEQ ID NO: 50223 - RNA, 20 nt, Artificial Sequence
  CIITA targeting sequence
ggccuccuuuauaucacuuu

SEQ ID NO: 50224 - RNA, 20 nt, Artificial Sequence
  CIITA targeting sequence
aauuauuaguuuucuggccu

SEQ ID NO: 50225 - RNA, 20 nt, Artificial Sequence
  CIITA targeting sequence
gcacucaaauuauuaguuuu

SEQ ID NO: 50226 - RNA, 20 nt, Artificial Sequence
  CIITA targeting sequence
gcauacugaccagucaccuu

SEQ ID NO: 50227 - RNA, 20 nt, Artificial Sequence
  CIITA targeting sequence
guaugcagaaucugcacuca

SEQ ID NO: 50228 - RNA, 20 nt, Artificial Sequence
  CIITA targeting sequence
ccuugugucaaaucuguugu

SEQ ID NO: 50229 - RNA, 20 nt, Artificial Sequence
  CIITA targeting sequence
aaucuguuguaauuugccug

SEQ ID NO: 50230 - RNA, 20 nt, Artificial Sequence
  CIITA targeting sequence
guuguaauuugccugaacuu

SEQ ID NO: 50231 - RNA, 20 nt, Artificial Sequence
  CIITA targeting sequence
ggcaaauuacaacagauuug

SEQ ID NO: 50232 - RNA, 20 nt, Artificial Sequence
  CIITA targeting sequence
caacaaugcuaggaagucca

SEQ ID NO: 50233 - RNA, 20 nt, Artificial Sequence
  CIITA targeting sequence
uagcauuguugugaaguuca

SEQ ID NO: 50234 - RNA, 20 nt, Artificial Sequence
  CIITA targeting sequence
auuuuuccccaaaaaauuuu

SEQ ID NO: 50235 - RNA, 20 nt, Artificial Sequence
  CIITA targeting sequence
ccaaaaaauuuuauuuugaa

SEQ ID NO: 50236 - RNA, 20 nt, Artificial Sequence
  CIITA targeting sequence
aaauaaaauuuuuuggggaa

SEQ ID NO: 50237 - RNA, 20 nt, Artificial Sequence
  CIITA targeting sequence
aagcauacaaccaaguugaa

SEQ ID NO: 50238 - RNA, 20 nt, Artificial Sequence
  CIITA targeting sequence
acuugguuguaugcuuggaa

SEQ ID NO: 50239 - RNA, 20 nt, Artificial Sequence
  CIITA targeting sequence
uucaacuugguuguaugcuu

SEQ ID NO: 50240 - RNA, 20 nt, Artificial Sequence
  CIITA targeting sequence
cuauacaauucuuucaacuu

SEQ ID NO: 50241 - RNA, 20 nt, Artificial Sequence
  CIITA targeting sequence
uacuugucuacuugucuuau

SEQ ID NO: 50242 - RNA, 20 nt, Artificial Sequence
  CIITA targeting sequence
acuugucuuaucacguaucu

SEQ ID NO: 50243 - RNA, 20 nt, Artificial Sequence
  CIITA targeting sequence
uaucacguaucuacuuuauc

SEQ ID NO: 50244 - RNA, 20 nt, Artificial Sequence
  CIITA targeting sequence
cguaucuacuuuauccacca

SEQ ID NO: 50245 - RNA, 20 nt, Artificial Sequence
  CIITA targeting sequence
acuuuauccaccaaacuuuu

SEQ ID NO: 50246 - RNA, 20 nt, Artificial Sequence
  CIITA targeting sequence
accaaacuuuuuuguggggg

SEQ ID NO: 50247 - RNA, 20 nt, Artificial Sequence
  CIITA targeting sequence
cccacaaaaaaguuuggugg

SEQ ID NO: 50248 - RNA, 20 nt, Artificial Sequence
  CIITA targeting sequence
cccccacaaaaaaguuuggu

SEQ ID NO: 50249 - RNA, 20 nt, Artificial Sequence
  CIITA targeting sequence
aacucucccccacaaaaaag

SEQ ID NO: 50250 - RNA, 20 nt, Artificial Sequence
  CIITA targeting sequence
cucucacccaggcuggagug

SEQ ID NO: 50251 - RNA, 20 nt, Artificial Sequence
  CIITA targeting sequence
cucacccaggcuggagugca

SEQ ID NO: 50252 - RNA, 20 nt, Artificial Sequence
  CIITA targeting sequence
cacccaggcuggagugcagu

SEQ ID NO: 50253 - RNA, 20 nt, Artificial Sequence
  CIITA targeting sequence
cccaggcuggagugcagugu

SEQ ID NO: 50254 - RNA, 20 nt, Artificial Sequence
  CIITA targeting sequence
agccugggugagagagacuc

SEQ ID NO: 50255 - RNA, 20 nt, Artificial Sequence
  CIITA targeting sequence
aaacacugcacuccagccug

SEQ ID NO: 50256 - RNA, 20 nt, Artificial Sequence
  CIITA targeting sequence
uagcucacugcagccucgaa

SEQ ID NO: 50257 - RNA, 20 nt, Artificial Sequence
  CIITA targeting sequence
cugcagccucgaacuccugg

SEQ ID NO: 50258 - RNA, 20 nt, Artificial Sequence
  CIITA targeting sequence
aagcuuuauugugagcucau

SEQ ID NO: 50259 - RNA, 20 nt, Artificial Sequence
  CIITA targeting sequence
ggugguuucuaagcuuuauu

SEQ ID NO: 50260 - RNA, 20 nt, Artificial Sequence
  CIITA targeting sequence
accacacgggagaauccaca

SEQ ID NO: 50261 - RNA, 20 nt, Artificial Sequence
  CIITA targeting sequence
cgugugguggauuuuucugg

SEQ ID NO: 50262 - RNA, 20 nt, Artificial Sequence
  CIITA targeting sequence
cccgugugguggauuuuucu

SEQ ID NO: 50263 - RNA, 20 nt, Artificial Sequence
  CIITA targeting sequence
acagacagagcaucaggcac

SEQ ID NO: 50264 - RNA, 20 nt, Artificial Sequence
  CIITA targeting sequence
guggauucucccguguggug

SEQ ID NO: 50265 - RNA, 20 nt, Artificial Sequence
  CIITA targeting sequence
gucuguggauucucccgugu

SEQ ID NO: 50266 - RNA, 20 nt, Artificial Sequence
  CIITA targeting sequence
ggcacagcagguccaucugg

SEQ ID NO: 50267 - RNA, 20 nt, Artificial Sequence
  CIITA targeting sequence
aucuggguggucugugcugg

SEQ ID NO: 50268 - RNA, 20 nt, Artificial Sequence
  CIITA targeting sequence
ggguggucugugcuggagug

SEQ ID NO: 50269 - RNA, 20 nt, Artificial Sequence
  CIITA targeting sequence
gugcuggaguggcuuauaga

SEQ ID NO: 50270 - RNA, 20 nt, Artificial Sequence
  CIITA targeting sequence
agcacagaccacccagaugg

SEQ ID NO: 50271 - RNA, 20 nt, Artificial Sequence
  CIITA targeting sequence
auaagccacuccagcacaga

SEQ ID NO: 50272 - RNA, 20 nt, Artificial Sequence
  CIITA targeting sequence
gaugucaauaugaaaucgca

SEQ ID NO: 50273 - RNA, 20 nt, Artificial Sequence
  CIITA targeting sequence
gaucuauaagccacuccagc

SEQ ID NO: 50274 - RNA, 20 nt, Artificial Sequence
  CIITA targeting sequence
auaugaaaucgcagcucugu

SEQ ID NO: 50275 - RNA, 20 nt, Artificial Sequence
  CIITA targeting sequence
uauugacaucagaucuauaa

SEQ ID NO: 50276 - RNA, 20 nt, Artificial Sequence
  CIITA targeting sequence
cagcucuguggcugcaaaac

SEQ ID NO: 50277 - RNA, 20 nt, Artificial Sequence
  CIITA targeting sequence
guggcugcaaaacccccuuc

SEQ ID NO: 50278 - RNA, 20 nt, Artificial Sequence
  CIITA targeting sequence
cguuuacacccccaaauccu

SEQ ID NO: 50279 - RNA, 20 nt, Artificial Sequence
  CIITA targeting sequence
ucagucaccaccgcuucuca

SEQ ID NO: 50280 - RNA, 20 nt, Artificial Sequence
  CIITA targeting sequence
gucaccaccgcuucucacaa

SEQ ID NO: 50281 - RNA, 20 nt, Artificial Sequence
  CIITA targeting sequence
ccaccgcuucucacaaaugc

SEQ ID NO: 50282 - RNA, 20 nt, Artificial Sequence
  CIITA targeting sequence
cacaaaugccucaugggagc

SEQ ID NO: 50283 - RNA, 20 nt, Artificial Sequence
  CIITA targeting sequence
caaaugccucaugggagcau

SEQ ID NO: 50284 - RNA, 20 nt, Artificial Sequence
  CIITA targeting sequence
ugggagcaugaguuuuguuu

SEQ ID NO: 50285 - RNA, 20 nt, Artificial Sequence
  CIITA targeting sequence
caugaggcauuugugagaag

SEQ ID NO: 50286 - RNA, 20 nt, Artificial Sequence
  CIITA targeting sequence
ugcucccaugaggcauuugu

SEQ ID NO: 50287 - RNA, 20 nt, Artificial Sequence
  CIITA targeting sequence
aaacaaaacucaugcuccca

SEQ ID NO: 50288 - RNA, 20 nt, Artificial Sequence
  CIITA targeting sequence
cucaaaacaaaacucaugcu

SEQ ID NO: 50289 - RNA, 20 nt, Artificial Sequence
  CIITA targeting sequence
cuguaucccucaaaacaaaa

SEQ ID NO: 50290 - RNA, 20 nt, Artificial Sequence
  CIITA targeting sequence
ucccuguaucccucaaaaca

SEQ ID NO: 50291 - RNA, 20 nt, Artificial Sequence
  CIITA targeting sequence
guucuucccuguaucccuca

SEQ ID NO: 50292 - RNA, 20 nt, Artificial Sequence
  CIITA targeting sequence
gcugggguccacgggauuga

SEQ ID NO: 50293 - RNA, 20 nt, Artificial Sequence
  CIITA targeting sequence
acgggauugaggagcagagg

SEQ ID NO: 50294 - RNA, 20 nt, Artificial Sequence
  CIITA targeting sequence
cguggaccccagcagaaaug

SEQ ID NO: 50295 - RNA, 20 nt, Artificial Sequence
  CIITA targeting sequence
aucccguggaccccagcaga

SEQ ID NO: 50296 - RNA, 20 nt, Artificial Sequence
  CIITA targeting sequence
ucaaucccguggaccccagc

SEQ ID NO: 50297 - RNA, 20 nt, Artificial Sequence
  CIITA targeting sequence
gcuccucaaucccguggacc

SEQ ID NO: 50298 - RNA, 20 nt, Artificial Sequence
  CIITA targeting sequence
cucugcuccucaaucccgug

SEQ ID NO: 50299 - RNA, 20 nt, Artificial Sequence
  CIITA targeting sequence
gcacaugggcucccucugcu

SEQ ID NO: 50300 - RNA, 20 nt, Artificial Sequence
  CIITA targeting sequence
caccucugcacaugggcucc

SEQ ID NO: 50301 - RNA, 20 nt, Artificial Sequence
  CIITA targeting sequence
uauagucccaccucugcaca

SEQ ID NO: 50302 - RNA, 20 nt, Artificial Sequence
  CIITA targeting sequence
gguccaguuccguacauuug

SEQ ID NO: 50303 - RNA, 20 nt, Artificial Sequence
  CIITA targeting sequence
aguuccguacauuugggaga

SEQ ID NO: 50304 - RNA, 20 nt, Artificial Sequence
  CIITA targeting sequence
guacauuugggagacugggg

SEQ ID NO: 50305 - RNA, 20 nt, Artificial Sequence
  CIITA targeting sequence
caaauguacggaacuggacc

SEQ ID NO: 50306 - RNA, 20 nt, Artificial Sequence
  CIITA targeting sequence
cccaaauguacggaacugga

SEQ ID NO: 50307 - RNA, 20 nt, Artificial Sequence
  CIITA targeting sequence
agccccagucucccaaaugu

SEQ ID NO: 50308 - RNA, 20 nt, Artificial Sequence
  CIITA targeting sequence
ccagccccagucucccaaau

SEQ ID NO: 50309 - RNA, 20 nt, Artificial Sequence
  CIITA targeting sequence
cagccucuccagccccaguc

SEQ ID NO: 50310 - RNA, 20 nt, Artificial Sequence
  CIITA targeting sequence
ucacagccucuccagcccca

SEQ ID NO: 50311 - RNA, 20 nt, Artificial Sequence
  CIITA targeting sequence
cauccucacagccucuccag

SEQ ID NO: 50312 - RNA, 20 nt, Artificial Sequence
  CIITA targeting sequence
uuggaaauuagagaucugca

SEQ ID NO: 50313 - RNA, 20 nt, Artificial Sequence
  CIITA targeting sequence
aaggacucacauccucacag

SEQ ID NO: 50314 - RNA, 20 nt, Artificial Sequence
  CIITA targeting sequence
aauuuccaaggacucacauc

SEQ ID NO: 50315 - RNA, 20 nt, Artificial Sequence
  CIITA targeting sequence
cuaauuuccaaggacucaca

SEQ ID NO: 50316 - RNA, 20 nt, Artificial Sequence
  CIITA targeting sequence
gcaggggaaggcuuggcuuu

SEQ ID NO: 50317 - RNA, 20 nt, Artificial Sequence
  CIITA targeting sequence
ccugcagaucucuaauuucc

SEQ ID NO: 50318 - RNA, 20 nt, Artificial Sequence
  CIITA targeting sequence
acaggggauggaacucaggu

SEQ ID NO: 50319 - RNA, 20 nt, Artificial Sequence
  CIITA targeting sequence
ccuguggaaagccaagccuu

SEQ ID NO: 50320 - RNA, 20 nt, Artificial Sequence
  CIITA targeting sequence
auccccuguggaaagccaag

SEQ ID NO: 50321 - RNA, 20 nt, Artificial Sequence
  CIITA targeting sequence
gguuugggggcucuuacuua

SEQ ID NO: 50322 - RNA, 20 nt, Artificial Sequence
  CIITA targeting sequence
uacuuagccuaaagagacac

SEQ ID NO: 50323 - RNA, 20 nt, Artificial Sequence
  CIITA targeting sequence
uuaggcuaaguaagagcccc

SEQ ID NO: 50324 - RNA, 20 nt, Artificial Sequence
  CIITA targeting sequence
cuuuaggcuaaguaagagcc

SEQ ID NO: 50325 - RNA, 20 nt, Artificial Sequence
  CIITA targeting sequence
acucucccagggucaagggg

SEQ ID NO: 50326 - RNA, 20 nt, Artificial Sequence
  CIITA targeting sequence
agugucucuuuaggcuaagu

SEQ ID NO: 50327 - RNA, 20 nt, Artificial Sequence
  CIITA targeting sequence
cccagggucaaggggaggaa

SEQ ID NO: 50328 - RNA, 20 nt, Artificial Sequence
  CIITA targeting sequence
cagggucaaggggaggaagc

SEQ ID NO: 50329 - RNA, 20 nt, Artificial Sequence
  CIITA targeting sequence
aggggaggaagccugugcug

SEQ ID NO: 50330 - RNA, 20 nt, Artificial Sequence
  CIITA targeting sequence
ccuugacccugggagagucg

SEQ ID NO: 50331 - RNA, 20 nt, Artificial Sequence
  CIITA targeting sequence
uccccuugacccugggagag

SEQ ID NO: 50332 - RNA, 20 nt, Artificial Sequence
  CIITA targeting sequence
agcacaggcuuccuccccuu

SEQ ID NO: 50333 - RNA, 20 nt, Artificial Sequence
  CIITA targeting sequence
ccaccuggguccagcacagg

SEQ ID NO: 50334 - RNA, 20 nt, Artificial Sequence
  CIITA targeting sequence
gcucaccaccuggguccagc

SEQ ID NO: 50335 - RNA, 20 nt, Artificial Sequence
  CIITA targeting sequence
cugcucucguggggugaggc

SEQ ID NO: 50336 - RNA, 20 nt, Artificial Sequence
  CIITA targeting sequence
cguggggugaggcuggccug

SEQ ID NO: 50337 - RNA, 20 nt, Artificial Sequence
  CIITA targeting sequence
uggggugaggcuggccuggg

SEQ ID NO: 50338 - RNA, 20 nt, Artificial Sequence
  CIITA targeting sequence
ccccacgagagcagggaccu

SEQ ID NO: 50339 - RNA, 20 nt, Artificial Sequence
  CIITA targeting sequence
uguagccacguggccaggua

SEQ ID NO: 50340 - RNA, 20 nt, Artificial Sequence
  CIITA targeting sequence
guguuccuguagccacgugg

SEQ ID NO: 50341 - RNA, 20 nt, Artificial Sequence
  CIITA targeting sequence
ccuucuguguuccuguagcc

SEQ ID NO: 50342 - RNA, 20 nt, Artificial Sequence
  CIITA targeting sequence
cccaaagcugugccuccccu

SEQ ID NO: 50343 - RNA, 20 nt, Artificial Sequence
  CIITA targeting sequence
ccgucccccaaagcugugcc

SEQ ID NO: 50344 - RNA, 20 nt, Artificial Sequence
  CIITA targeting sequence
agagacagcagcaggucugg

SEQ ID NO: 50345 - RNA, 20 nt, Artificial Sequence
  CIITA targeting sequence
agaaaaaaaagucaccgucc

SEQ ID NO: 50346 - RNA, 20 nt, Artificial Sequence
  CIITA targeting sequence
cuagaaaaaaaagucaccgu

SEQ ID NO: 50347 - RNA, 20 nt, Artificial Sequence
  CIITA targeting sequence
ggauuugaauccggacucca

SEQ ID NO: 50348 - RNA, 20 nt, Artificial Sequence
  CIITA targeting sequence
agaccugcugcugucucuag

SEQ ID NO: 50349 - RNA, 20 nt, Artificial Sequence
  CIITA targeting sequence
aauccagaccugcugcuguc

SEQ ID NO: 50350 - RNA, 20 nt, Artificial Sequence
  CIITA targeting sequence
ggacuccacagggcguuacu

SEQ ID NO: 50351 - RNA, 20 nt, Artificial Sequence
  CIITA targeting sequence
ggauucaaauccagaccugc

SEQ ID NO: 50352 - RNA, 20 nt, Artificial Sequence
  CIITA targeting sequence
acagggcguuacugaguuuu

SEQ ID NO: 50353 - RNA, 20 nt, Artificial Sequence
  CIITA targeting sequence
guaacgcccuguggaguccg

SEQ ID NO: 50354 - RNA, 20 nt, Artificial Sequence
  CIITA targeting sequence
caugccucaguuuuccucuc

SEQ ID NO: 50355 - RNA, 20 nt, Artificial Sequence
  CIITA targeting sequence
guuuuccucuccauguaaug

SEQ ID NO: 50356 - RNA, 20 nt, Artificial Sequence
  CIITA targeting sequence
ucuccauguaauggggguaa

SEQ ID NO: 50357 - RNA, 20 nt, Artificial Sequence
  CIITA targeting sequence
ccauguaauggggguaauaa

SEQ ID NO: 50358 - RNA, 20 nt, Artificial Sequence
  CIITA targeting sequence
auguaauggggguaauaaua

SEQ ID NO: 50359 - RNA, 20 nt, Artificial Sequence
  CIITA targeting sequence
uccuccagggcacugagagg

SEQ ID NO: 50360 - RNA, 20 nt, Artificial Sequence
  CIITA targeting sequence
uccagggcacugagaggacu

SEQ ID NO: 50361 - RNA, 20 nt, Artificial Sequence
  CIITA targeting sequence
agggcacugagaggacugaa

SEQ ID NO: 50362 - RNA, 20 nt, Artificial Sequence
  CIITA targeting sequence
gugcccuggaggaagagcua

SEQ ID NO: 50363 - RNA, 20 nt, Artificial Sequence
  CIITA targeting sequence
cagugcccuggaggaagagc

SEQ ID NO: 50364 - RNA, 20 nt, Artificial Sequence
  CIITA targeting sequence
ucucagugcccuggaggaag

SEQ ID NO: 50365 - RNA, 20 nt, Artificial Sequence
  CIITA targeting sequence
guccucucagugcccuggag

SEQ ID NO: 50366 - RNA, 20 nt, Artificial Sequence
  CIITA targeting sequence
uucaguccucucagugcccu

SEQ ID NO: 50367 - RNA, 20 nt, Artificial Sequence
  CIITA targeting sequence
cauucaguccucucagugcc

SEQ ID NO: 50368 - RNA, 20 nt, Artificial Sequence
  CIITA targeting sequence
aguggguuuucucauucagu

SEQ ID NO: 50369 - RNA, 20 nt, Artificial Sequence
  CIITA targeting sequence
gggccagcugccuugucaag

SEQ ID NO: 50370 - RNA, 20 nt, Artificial Sequence
  CIITA targeting sequence
ucugggccagcugccuuguc

SEQ ID NO: 50371 - RNA, 20 nt, Artificial Sequence
  CIITA targeting sequence
cccagccuguccucugggcc

SEQ ID NO: 50372 - RNA, 20 nt, Artificial Sequence
  CIITA targeting sequence
uggaguuuauuacuaaugaa

SEQ ID NO: 50373 - RNA, 20 nt, Artificial Sequence
  CIITA targeting sequence
augaccauucgcccagccug

SEQ ID NO: 50374 - RNA, 20 nt, Artificial Sequence
  CIITA targeting sequence
uuaguaauaaacuccaugac

SEQ ID NO: 50375 - RNA, 20 nt, Artificial Sequence
  CIITA targeting sequence
uucauuaguaauaaacucca

SEQ ID NO: 50376 - RNA, 20 nt, Artificial Sequence
  CIITA targeting sequence
ggcccuucauucauuaguaa

SEQ ID NO: 50377 - RNA, 20 nt, Artificial Sequence
  CIITA targeting sequence
guggguccggcccuucauuc

SEQ ID NO: 50378 - RNA, 20 nt, Artificial Sequence
  CIITA targeting sequence
ucuguggguccggcccuuca

SEQ ID NO: 50379 - RNA, 20 nt, Artificial Sequence
  CIITA targeting sequence
cacaagugagccacugaucg

SEQ ID NO: 50380 - RNA, 20 nt, Artificial Sequence
  CIITA targeting sequence
cuugugugacucaucugugg

SEQ ID NO: 50381 - RNA, 20 nt, Artificial Sequence
  CIITA targeting sequence
guggcucacuugugugacuc

SEQ ID NO: 50382 - RNA, 20 nt, Artificial Sequence
  CIITA targeting sequence
aucugauaacaaugaaugga

SEQ ID NO: 50383 - RNA, 20 nt, Artificial Sequence
  CIITA targeting sequence
aucaguggcucacuugugug

SEQ ID NO: 50384 - RNA, 20 nt, Artificial Sequence
  CIITA targeting sequence
gauaacaaugaauggacaaa

SEQ ID NO: 50385 - RNA, 20 nt, Artificial Sequence
  CIITA targeting sequence
gaucgaucaguggcucacuu

SEQ ID NO: 50386 - RNA, 20 nt, Artificial Sequence
  CIITA targeting sequence
uuguuaucagaucgaucagu

SEQ ID NO: 50387 - RNA, 20 nt, Artificial Sequence
  CIITA targeting sequence
auucauuguuaucagaucga

SEQ ID NO: 50388 - RNA, 20 nt, Artificial Sequence
  CIITA targeting sequence
uuuguccauucauuguuauc

SEQ ID NO: 50389 - RNA, 20 nt, Artificial Sequence
  CIITA targeting sequence
uucauuuguccauucauugu

SEQ ID NO: 50390 - RNA, 20 nt, Artificial Sequence
  CIITA targeting sequence
uuucuuucauuuguccauuc

SEQ ID NO: 50391 - RNA, 20 nt, Artificial Sequence
  CIITA targeting sequence
augaaugaaaugcucagggc

SEQ ID NO: 50392 - RNA, 20 nt, Artificial Sequence
  CIITA targeting sequence
uugauucauuucuuucauuu

SEQ ID NO: 50393 - RNA, 20 nt, Artificial Sequence
  CIITA targeting sequence
uucauugauucauuucuuuc

SEQ ID NO: 50394 - RNA, 20 nt, Artificial Sequence
  CIITA targeting sequence
gggccugccucccagcacca

SEQ ID NO: 50395 - RNA, 20 nt, Artificial Sequence
  CIITA targeting sequence
cagcaccacagagaggggac

SEQ ID NO: 50396 - RNA, 20 nt, Artificial Sequence
  CIITA targeting sequence
guggugcugggaggcaggcc

SEQ ID NO: 50397 - RNA, 20 nt, Artificial Sequence
  CIITA targeting sequence
cuguggugcugggaggcagg

SEQ ID NO: 50398 - RNA, 20 nt, Artificial Sequence
  CIITA targeting sequence
ccucucuguggugcugggag

SEQ ID NO: 50399 - RNA, 20 nt, Artificial Sequence
  CIITA targeting sequence
ccagggccagguccccucuc

SEQ ID NO: 50400 - RNA, 20 nt, Artificial Sequence
  CIITA targeting sequence
ccuccccagggccagguccc

SEQ ID NO: 50401 - RNA, 20 nt, Artificial Sequence
  CIITA targeting sequence
uuccccuccccagggccagg

SEQ ID NO: 50402 - RNA, 20 nt, Artificial Sequence
  CIITA targeting sequence
ugcccuccuuccccucccca

SEQ ID NO: 50403 - RNA, 20 nt, Artificial Sequence
  CIITA targeting sequence
ccugcccuccuuccccuccc

SEQ ID NO: 50404 - RNA, 20 nt, Artificial Sequence
  CIITA targeting sequence
gggggugggccucuccugcc

SEQ ID NO: 50405 - RNA, 20 nt, Artificial Sequence
  CIITA targeting sequence
gcuuccagcagcuccagcuc

SEQ ID NO: 50406 - RNA, 20 nt, Artificial Sequence
  CIITA targeting sequence
agcagcuccagcucagaaaa

SEQ ID NO: 50407 - RNA, 20 nt, Artificial Sequence
  CIITA targeting sequence
agcucagaaaaaguucagcg

SEQ ID NO: 50408 - RNA, 20 nt, Artificial Sequence
  CIITA targeting sequence
gaaaaaguucagcggccagg

SEQ ID NO: 50409 - RNA, 20 nt, Artificial Sequence
  CIITA targeting sequence
gagcuggagcugcuggaagc

SEQ ID NO: 50410 - RNA, 20 nt, Artificial Sequence
  CIITA targeting sequence
gcggccaggugacggacaca

SEQ ID NO: 50411 - RNA, 20 nt, Artificial Sequence
  CIITA targeting sequence
ccuggccgcugaacuuuuuc

SEQ ID NO: 50412 - RNA, 20 nt, Artificial Sequence
  CIITA targeting sequence
gucaccuggccgcugaacuu

SEQ ID NO: 50413 - RNA, 20 nt, Artificial Sequence
  CIITA targeting sequence
caggugugcgccaugugucc

SEQ ID NO: 50414 - RNA, 20 nt, Artificial Sequence
  CIITA targeting sequence
cucccccacaucgugccaag

SEQ ID NO: 50415 - RNA, 20 nt, Artificial Sequence
  CIITA targeting sequence
cccacaucgugccaagggga

SEQ ID NO: 50416 - RNA, 20 nt, Artificial Sequence
  CIITA targeting sequence
ugccaaggggaucgaaggau

SEQ ID NO: 50417 - RNA, 20 nt, Artificial Sequence
  CIITA targeting sequence
ccuuggcacgauguggggga

SEQ ID NO: 50418 - RNA, 20 nt, Artificial Sequence
  CIITA targeting sequence
aaggauuccccugagucauc

SEQ ID NO: 50419 - RNA, 20 nt, Artificial Sequence
  CIITA targeting sequence
auccccuuggcacgaugugg

SEQ ID NO: 50420 - RNA, 20 nt, Artificial Sequence
  CIITA targeting sequence
uucgauccccuuggcacgau

SEQ ID NO: 50421 - RNA, 20 nt, Artificial Sequence
  CIITA targeting sequence
ccugagucaucuuccugcag

SEQ ID NO: 50422 - RNA, 20 nt, Artificial Sequence
  CIITA targeting sequence
ggggaauccuucgauccccu

SEQ ID NO: 50423 - RNA, 20 nt, Artificial Sequence
  CIITA targeting sequence
ucuuccugcaggccagccug

SEQ ID NO: 50424 - RNA, 20 nt, Artificial Sequence
  CIITA targeting sequence
uccugcaggccagccugcag

SEQ ID NO: 50425 - RNA, 20 nt, Artificial Sequence
  CIITA targeting sequence
ugcaggccagccugcagcuc

SEQ ID NO: 50426 - RNA, 20 nt, Artificial Sequence
  CIITA targeting sequence
ugcagcucccgguuccuccc

SEQ ID NO: 50427 - RNA, 20 nt, Artificial Sequence
  CIITA targeting sequence
cgguuccucccccuggcccg

SEQ ID NO: 50428 - RNA, 20 nt, Artificial Sequence
  CIITA targeting sequence
ucccccuggcccggcagagg

SEQ ID NO: 50429 - RNA, 20 nt, Artificial Sequence
  CIITA targeting sequence
cccuggcccggcagagggug

SEQ ID NO: 50430 - RNA, 20 nt, Artificial Sequence
  CIITA targeting sequence
gccgggccagggggaggaac

SEQ ID NO: 50431 - RNA, 20 nt, Artificial Sequence
  CIITA targeting sequence
cccucugccgggccaggggg

SEQ ID NO: 50432 - RNA, 20 nt, Artificial Sequence
  CIITA targeting sequence
cccaaaaagcccuuaaucac

SEQ ID NO: 50433 - RNA, 20 nt, Artificial Sequence
  CIITA targeting sequence
uuucccccaaaaagcccuua

SEQ ID NO: 50434 - RNA, 20 nt, Artificial Sequence
  CIITA targeting sequence
uuuaacugucauuuccccca

SEQ ID NO: 50435 - RNA, 20 nt, Artificial Sequence
  CIITA targeting sequence
gcaaggaguguccagccugg

SEQ ID NO: 50436 - RNA, 20 nt, Artificial Sequence
  CIITA targeting sequence
uugcugagucuuuuaacugu

SEQ ID NO: 50437 - RNA, 20 nt, Artificial Sequence
  CIITA targeting sequence
agccuggcgagucaggggcu

SEQ ID NO: 50438 - RNA, 20 nt, Artificial Sequence
  CIITA targeting sequence
ccaggcuggacacuccuugc

SEQ ID NO: 50439 - RNA, 20 nt, Artificial Sequence
  CIITA targeting sequence
ggggcugugggcaggacuca

SEQ ID NO: 50440 - RNA, 20 nt, Artificial Sequence
  CIITA targeting sequence
ugcccacagccccugacucg

SEQ ID NO: 50441 - RNA, 20 nt, Artificial Sequence
  CIITA targeting sequence
ggaagggcccccuggccccu

SEQ ID NO: 50442 - RNA, 20 nt, Artificial Sequence
  CIITA targeting sequence
ugaguccugcccacagcccc

SEQ ID NO: 50443 - RNA, 20 nt, Artificial Sequence
  CIITA targeting sequence
uggccucagagggagccucg

SEQ ID NO: 50444 - RNA, 20 nt, Artificial Sequence
  CIITA targeting sequence
gagggagccucguccgagug

SEQ ID NO: 50445 - RNA, 20 nt, Artificial Sequence
  CIITA targeting sequence
gaggccaggaaggggccagg

SEQ ID NO: 50446 - RNA, 20 nt, Artificial Sequence
  CIITA targeting sequence
cucugaggccaggaaggggc

SEQ ID NO: 50447 - RNA, 20 nt, Artificial Sequence
  CIITA targeting sequence
uccgaguggcagggcuugcu

SEQ ID NO: 50448 - RNA, 20 nt, Artificial Sequence
  CIITA targeting sequence
gaguggcagggcuugcugau

SEQ ID NO: 50449 - RNA, 20 nt, Artificial Sequence
  CIITA targeting sequence
gacgaggcucccucugaggc

SEQ ID NO: 50450 - RNA, 20 nt, Artificial Sequence
  CIITA targeting sequence
gcaagcccugccacucggac

SEQ ID NO: 50451 - RNA, 20 nt, Artificial Sequence
  CIITA targeting sequence
uugaagugggagagggauag

SEQ ID NO: 50452 - RNA, 20 nt, Artificial Sequence
  CIITA targeting sequence
aggaucagcaagcccugcca

SEQ ID NO: 50453 - RNA, 20 nt, Artificial Sequence
  CIITA targeting sequence
cacuucaaggaucagcaagc

SEQ ID NO: 50454 - RNA, 20 nt, Artificial Sequence
  CIITA targeting sequence
cccacuucaaggaucagcaa

SEQ ID NO: 50455 - RNA, 20 nt, Artificial Sequence
  CIITA targeting sequence
cucucccacuucaaggauca

SEQ ID NO: 50456 - RNA, 20 nt, Artificial Sequence
  CIITA targeting sequence
accacaauaaguaauaggaa

SEQ ID NO: 50457 - RNA, 20 nt, Artificial Sequence
  CIITA targeting sequence
uauuacuuauugugguggau

SEQ ID NO: 50458 - RNA, 20 nt, Artificial Sequence
  CIITA targeting sequence
uuccuauuacuuauuguggu

SEQ ID NO: 50459 - RNA, 20 nt, Artificial Sequence
  CIITA targeting sequence
uugucauuccuauuacuuau

SEQ ID NO: 50460 - RNA, 20 nt, Artificial Sequence
  CIITA targeting sequence
gugcccagggcugcucguuu

SEQ ID NO: 50461 - RNA, 20 nt, Artificial Sequence
  CIITA targeting sequence
uuuguuucuucauuuagucc

SEQ ID NO: 50462 - RNA, 20 nt, Artificial Sequence
  CIITA targeting sequence
ucauuuaguccucagcuccc

SEQ ID NO: 50463 - RNA, 20 nt, Artificial Sequence
  CIITA targeting sequence
uuuaguccucagcucccuac

SEQ ID NO: 50464 - RNA, 20 nt, Artificial Sequence
  CIITA targeting sequence
ucagcucccuaccgaaggca

SEQ ID NO: 50465 - RNA, 20 nt, Artificial Sequence
  CIITA targeting sequence
gcucccuaccgaaggcagcc

SEQ ID NO: 50466 - RNA, 20 nt, Artificial Sequence
  CIITA targeting sequence
cuaccgaaggcagccgucug

SEQ ID NO: 50467 - RNA, 20 nt, Artificial Sequence
  CIITA targeting sequence
guagggagcugaggacuaaa

SEQ ID NO: 50468 - RNA, 20 nt, Artificial Sequence
  CIITA targeting sequence
gcugaaaccauaagaaauug

SEQ ID NO: 50469 - RNA, 20 nt, Artificial Sequence
  CIITA targeting sequence
gcagacggcugccuucggua

SEQ ID NO: 50470 - RNA, 20 nt, Artificial Sequence
  CIITA targeting sequence
uaugguuucagcagacggcu

SEQ ID NO: 50471 - RNA, 20 nt, Artificial Sequence
  CIITA targeting sequence
gcaauuucuuaugguuucag

SEQ ID NO: 50472 - RNA, 20 nt, Artificial Sequence
  CIITA targeting sequence
gaucuugacccacaaaaaug

SEQ ID NO: 50473 - RNA, 20 nt, Artificial Sequence
  CIITA targeting sequence
gacaggcaaucagcaauuuc

SEQ ID NO: 50474 - RNA, 20 nt, Artificial Sequence
  CIITA targeting sequence
ugacccacaaaaauggcaau

SEQ ID NO: 50475 - RNA, 20 nt, Artificial Sequence
  CIITA targeting sequence
agaucagacaggcaaucagc

SEQ ID NO: 50476 - RNA, 20 nt, Artificial Sequence
  CIITA targeting sequence
caugugucauucgaucuaau

SEQ ID NO: 50477 - RNA, 20 nt, Artificial Sequence
  CIITA targeting sequence
ugugucauucgaucuaauag

SEQ ID NO: 50478 - RNA, 20 nt, Artificial Sequence
  CIITA targeting sequence
uucgaucuaauagucccauu

SEQ ID NO: 50479 - RNA, 20 nt, Artificial Sequence
  CIITA targeting sequence
aucuaauagucccauuauuc

SEQ ID NO: 50480 - RNA, 20 nt, Artificial Sequence
  CIITA targeting sequence
aaugacacaugagauugcca

SEQ ID NO: 50481 - RNA, 20 nt, Artificial Sequence
  CIITA targeting sequence
aauagucccauuauuccuau

SEQ ID NO: 50482 - RNA, 20 nt, Artificial Sequence
  CIITA targeting sequence
cauuauuccuauuuugcaga

SEQ ID NO: 50483 - RNA, 20 nt, Artificial Sequence
  CIITA targeting sequence
uauuuugcagaaaaucacgg

SEQ ID NO: 50484 - RNA, 20 nt, Artificial Sequence
  CIITA targeting sequence
gcaaaauaggaauaauggga

SEQ ID NO: 50485 - RNA, 20 nt, Artificial Sequence
  CIITA targeting sequence
cggcucagagaggcugagca

SEQ ID NO: 50486 - RNA, 20 nt, Artificial Sequence
  CIITA targeting sequence
gagaggcugagcagccugca

SEQ ID NO: 50487 - RNA, 20 nt, Artificial Sequence
  CIITA targeting sequence
gagccgugauuuucugcaaa

SEQ ID NO: 50488 - RNA, 20 nt, Artificial Sequence
  CIITA targeting sequence
cugagccgugauuuucugca

SEQ ID NO: 50489 - RNA, 20 nt, Artificial Sequence
  CIITA targeting sequence
gccucucugagccgugauuu

SEQ ID NO: 50490 - RNA, 20 nt, Artificial Sequence
  CIITA targeting sequence
uuugcaggcugcucagccuc

SEQ ID NO: 50491 - RNA, 20 nt, Artificial Sequence
  CIITA targeting sequence
ccuuugcaggcugcucagcc

SEQ ID NO: 50492 - RNA, 20 nt, Artificial Sequence
  CIITA targeting sequence
cuggcucuccuuugcaggcu

SEQ ID NO: 50493 - RNA, 20 nt, Artificial Sequence
  CIITA targeting sequence
caggcuuggguggcagcauc

SEQ ID NO: 50494 - RNA, 20 nt, Artificial Sequence
  CIITA targeting sequence
cccaggcuuggguggcagca

SEQ ID NO: 50495 - RNA, 20 nt, Artificial Sequence
  CIITA targeting sequence
gccccaagccugggcacccc

SEQ ID NO: 50496 - RNA, 20 nt, Artificial Sequence
  CIITA targeting sequence
cucagccccaagccugggca

SEQ ID NO: 50497 - RNA, 20 nt, Artificial Sequence
  CIITA targeting sequence
uggucugggaacagaagugc

SEQ ID NO: 50498 - RNA, 20 nt, Artificial Sequence
  CIITA targeting sequence
gggaacagaagugcccaggg

SEQ ID NO: 50499 - RNA, 20 nt, Artificial Sequence
  CIITA targeting sequence
cagaccaggagccucccuca

SEQ ID NO: 50500 - RNA, 20 nt, Artificial Sequence
  CIITA targeting sequence
guucccagaccaggagccuc

SEQ ID NO: 50501 - RNA, 20 nt, Artificial Sequence
  CIITA targeting sequence
ccugggcacuucuguuccca

SEQ ID NO: 50502 - RNA, 20 nt, Artificial Sequence
  CIITA targeting sequence
aguguccccugggcacuucu

SEQ ID NO: 50503 - RNA, 20 nt, Artificial Sequence
  CIITA targeting sequence
gcucuaguguccccugggca

SEQ ID NO: 50504 - RNA, 20 nt, Artificial Sequence
  CIITA targeting sequence
cccagggggcaggugcagcc

SEQ ID NO: 50505 - RNA, 20 nt, Artificial Sequence
  CIITA targeting sequence
cuucccccagggggcaggug

SEQ ID NO: 50506 - RNA, 20 nt, Artificial Sequence
  CIITA targeting sequence
ccaguguuggccccaccucc

SEQ ID NO: 50507 - RNA, 20 nt, Artificial Sequence
  CIITA targeting sequence
cuccuggcgauccccaggcu

SEQ ID NO: 50508 - RNA, 20 nt, Artificial Sequence
  CIITA targeting sequence
uggcgauccccaggcugggg

SEQ ID NO: 50509 - RNA, 20 nt, Artificial Sequence
  CIITA targeting sequence
ccaggagggagcccugcguc

SEQ ID NO: 50510 - RNA, 20 nt, Artificial Sequence
  CIITA targeting sequence
ccaggcugggggaauuuggu

SEQ ID NO: 50511 - RNA, 20 nt, Artificial Sequence
  CIITA targeting sequence
cccagccuggggaucgccag

SEQ ID NO: 50512 - RNA, 20 nt, Artificial Sequence
  CIITA targeting sequence
ccagcaccaaauucccccag

SEQ ID NO: 50513 - RNA, 20 nt, Artificial Sequence
  CIITA targeting sequence
aaauccccagcaccaaauuc

SEQ ID NO: 50514 - RNA, 20 nt, Artificial Sequence
  CIITA targeting sequence
aacugcucaaaauccccagc

SEQ ID NO: 50515 - RNA, 20 nt, Artificial Sequence
  CIITA targeting sequence
ugccuucuggcuggggcccc

SEQ ID NO: 50516 - RNA, 20 nt, Artificial Sequence
  CIITA targeting sequence
ggcuggggccccgugggagu

SEQ ID NO: 50517 - RNA, 20 nt, Artificial Sequence
  CIITA targeting sequence
cacggggccccagccagaag

SEQ ID NO: 50518 - RNA, 20 nt, Artificial Sequence
  CIITA targeting sequence
cccacucccacggggcccca

SEQ ID NO: 50519 - RNA, 20 nt, Artificial Sequence
  CIITA targeting sequence
aucuguccauccauccaggg

SEQ ID NO: 50520 - RNA, 20 nt, Artificial Sequence
  CIITA targeting sequence
guccauccauccagggaguc

SEQ ID NO: 50521 - RNA, 20 nt, Artificial Sequence
  CIITA targeting sequence
auccauccagggagucucuc

SEQ ID NO: 50522 - RNA, 20 nt, Artificial Sequence
  CIITA targeting sequence
auccagggagucucuccagu

SEQ ID NO: 50523 - RNA, 20 nt, Artificial Sequence
  CIITA targeting sequence
agggagucucuccaguggug

SEQ ID NO: 50524 - RNA, 20 nt, Artificial Sequence
  CIITA targeting sequence
cuggauggauggacagaugg

SEQ ID NO: 50525 - RNA, 20 nt, Artificial Sequence
  CIITA targeting sequence
cuccagugguggccgucacu

SEQ ID NO: 50526 - RNA, 20 nt, Artificial Sequence
  CIITA targeting sequence
ccagugguggccgucacugg

SEQ ID NO: 50527 - RNA, 20 nt, Artificial Sequence
  CIITA targeting sequence
agugguggccgucacugggg

SEQ ID NO: 50528 - RNA, 20 nt, Artificial Sequence
  CIITA targeting sequence
cuggggccgucugcagagcc

SEQ ID NO: 50529 - RNA, 20 nt, Artificial Sequence
  CIITA targeting sequence
gcagagccucucuggggcau

SEQ ID NO: 50530 - RNA, 20 nt, Artificial Sequence
  CIITA targeting sequence
gcagacggccccagugacgg

SEQ ID NO: 50531 - RNA, 20 nt, Artificial Sequence
  CIITA targeting sequence
cuggggcauuaauuuaacau

SEQ ID NO: 50532 - RNA, 20 nt, Artificial Sequence
  CIITA targeting sequence
ggggcauuaauuuaacaugc

SEQ ID NO: 50533 - RNA, 20 nt, Artificial Sequence
  CIITA targeting sequence
ccuuugcauguuaaauuaau

SEQ ID NO: 50534 - RNA, 20 nt, Artificial Sequence
  CIITA targeting sequence
cuggguuccccuuugcaugu

SEQ ID NO: 50535 - RNA, 20 nt, Artificial Sequence
  CIITA targeting sequence
cccuggguuccccuuugcau

SEQ ID NO: 50536 - RNA, 20 nt, Artificial Sequence
  CIITA targeting sequence
gcacugcccucucccugggu

SEQ ID NO: 50537 - RNA, 20 nt, Artificial Sequence
  CIITA targeting sequence
ggguucagcacugcccucuc

SEQ ID NO: 50538 - RNA, 20 nt, Artificial Sequence
  CIITA targeting sequence
cucuggguucagcacugccc

SEQ ID NO: 50539 - RNA, 20 nt, Artificial Sequence
  CIITA targeting sequence
cccacccccucccucugggu

SEQ ID NO: 50540 - RNA, 20 nt, Artificial Sequence
  CIITA targeting sequence
gcccaaaaugccaccaucac

SEQ ID NO: 50541 - RNA, 20 nt, Artificial Sequence
  CIITA targeting sequence
guaugguuuucuccccagag

SEQ ID NO: 50542 - RNA, 20 nt, Artificial Sequence
  CIITA targeting sequence
ccccagagagugucuuucua

SEQ ID NO: 50543 - RNA, 20 nt, Artificial Sequence
  CIITA targeting sequence
ccagagagugucuuucuaga

SEQ ID NO: 50544 - RNA, 20 nt, Artificial Sequence
  CIITA targeting sequence
ggggagaaaaccauacugaa

SEQ ID NO: 50545 - RNA, 20 nt, Artificial Sequence
  CIITA targeting sequence
cuggggagaaaaccauacug

SEQ ID NO: 50546 - RNA, 20 nt, Artificial Sequence
  CIITA targeting sequence
uucuagaacgucuuucuaga

SEQ ID NO: 50547 - RNA, 20 nt, Artificial Sequence
  CIITA targeting sequence
agaacgucuuucuagacucc

SEQ ID NO: 50548 - RNA, 20 nt, Artificial Sequence
  CIITA targeting sequence
agaaagacacucucugggga

SEQ ID NO: 50549 - RNA, 20 nt, Artificial Sequence
  CIITA targeting sequence
uucuagacuccugggacacu

SEQ ID NO: 50550 - RNA, 20 nt, Artificial Sequence
  CIITA targeting sequence
agacuccugggacacuggug

SEQ ID NO: 50551 - RNA, 20 nt, Artificial Sequence
  CIITA targeting sequence
agaaagacguucuagaaaga

SEQ ID NO: 50552 - RNA, 20 nt, Artificial Sequence
  CIITA targeting sequence
ugggacacugguguaauugg

SEQ ID NO: 50553 - RNA, 20 nt, Artificial Sequence
  CIITA targeting sequence
caggagucuagaaagacguu

SEQ ID NO: 50554 - RNA, 20 nt, Artificial Sequence
  CIITA targeting sequence
caggccaauuacaccagugu

SEQ ID NO: 50555 - RNA, 20 nt, Artificial Sequence
  CIITA targeting sequence
ggggcugguuggccucacag

SEQ ID NO: 50556 - RNA, 20 nt, Artificial Sequence
  CIITA targeting sequence
gggaauuuggagaccugccc

SEQ ID NO: 50557 - RNA, 20 nt, Artificial Sequence
  CIITA targeting sequence
cagaaacaucuggggcuggu

SEQ ID NO: 50558 - RNA, 20 nt, Artificial Sequence
  CIITA targeting sequence
aaauucccagaaacaucugg

SEQ ID NO: 50559 - RNA, 20 nt, Artificial Sequence
  CIITA targeting sequence
ccaaauucccagaaacaucu

SEQ ID NO: 50560 - RNA, 20 nt, Artificial Sequence
  CIITA targeting sequence
cuugcagggggcaggucucc

SEQ ID NO: 50561 - RNA, 20 nt, Artificial Sequence
  CIITA targeting sequence
gaugcuuuccguggaagggg

SEQ ID NO: 50562 - RNA, 20 nt, Artificial Sequence
  CIITA targeting sequence
gagucccuugcagggggcag

SEQ ID NO: 50563 - RNA, 20 nt, Artificial Sequence
  CIITA targeting sequence
guggaaggggccagggaggg

SEQ ID NO: 50564 - RNA, 20 nt, Artificial Sequence
  CIITA targeting sequence
acggaaagcaucugaguccc

SEQ ID NO: 50565 - RNA, 20 nt, Artificial Sequence
  CIITA targeting sequence
cuggccccuuccacggaaag

SEQ ID NO: 50566 - RNA, 20 nt, Artificial Sequence
  CIITA targeting sequence
ccucccuggccccuuccacg

SEQ ID NO: 50567 - RNA, 20 nt, Artificial Sequence
  CIITA targeting sequence
uccccucccuggccccuucc

SEQ ID NO: 50568 - RNA, 20 nt, Artificial Sequence
  CIITA targeting sequence
cacugaaccgucguggucac

SEQ ID NO: 50569 - RNA, 20 nt, Artificial Sequence
  CIITA targeting sequence
cugaaccgucguggucacuc

SEQ ID NO: 50570 - RNA, 20 nt, Artificial Sequence
  CIITA targeting sequence
gugagaccuuggugccucuu

SEQ ID NO: 50571 - RNA, 20 nt, Artificial Sequence
  CIITA targeting sequence
uggucacucugaacauucau

SEQ ID NO: 50572 - RNA, 20 nt, Artificial Sequence
  CIITA targeting sequence
cucugaacauucaugccacu

SEQ ID NO: 50573 - RNA, 20 nt, Artificial Sequence
  CIITA targeting sequence
gaacauucaugccacuuggc

SEQ ID NO: 50574 - RNA, 20 nt, Artificial Sequence
  CIITA targeting sequence
gagugaccacgacgguucag

SEQ ID NO: 50575 - RNA, 20 nt, Artificial Sequence
  CIITA targeting sequence
ugccacuuggcaugagcccu

SEQ ID NO: 50576 - RNA, 20 nt, Artificial Sequence
  CIITA targeting sequence
ugccaaguggcaugaauguu

SEQ ID NO: 50577 - RNA, 20 nt, Artificial Sequence
  CIITA targeting sequence
cucuccagacuguaaaauca

SEQ ID NO: 50578 - RNA, 20 nt, Artificial Sequence
  CIITA targeting sequence
ccagacuguaaaaucaauac

SEQ ID NO: 50579 - RNA, 20 nt, Artificial Sequence
  CIITA targeting sequence
agacuguaaaaucaauaccu

SEQ ID NO: 50580 - RNA, 20 nt, Artificial Sequence
  CIITA targeting sequence
ggagagugaagggcucaugc

SEQ ID NO: 50581 - RNA, 20 nt, Artificial Sequence
  CIITA targeting sequence
auaccuggcccaaauagcaa

SEQ ID NO: 50582 - RNA, 20 nt, Artificial Sequence
  CIITA targeting sequence
uuguuguugcuauuugggcc

SEQ ID NO: 50583 - RNA, 20 nt, Artificial Sequence
  CIITA targeting sequence
acguggcaccuccugucugu

SEQ ID NO: 50584 - RNA, 20 nt, Artificial Sequence
  CIITA targeting sequence
ugucugucuccagggcgcug

SEQ ID NO: 50585 - RNA, 20 nt, Artificial Sequence
  CIITA targeting sequence
gucuccagggcgcugcgcuu

SEQ ID NO: 50586 - RNA, 20 nt, Artificial Sequence
  CIITA targeting sequence
ccagggcgcugcgcuucauu

SEQ ID NO: 50587 - RNA, 20 nt, Artificial Sequence
  CIITA targeting sequence
agggcgcugcgcuucauuaa

SEQ ID NO: 50588 - RNA, 20 nt, Artificial Sequence
  CIITA targeting sequence
uuaagcaccacacacccaag

SEQ ID NO: 50589 - RNA, 20 nt, Artificial Sequence
  CIITA targeting sequence
uggguguguggugcuuaaug

SEQ ID NO: 50590 - RNA, 20 nt, Artificial Sequence
  CIITA targeting sequence
agggagucucaugacuaggc

SEQ ID NO: 50591 - RNA, 20 nt, Artificial Sequence
  CIITA targeting sequence
gugacccuccauugcacguu

SEQ ID NO: 50592 - RNA, 20 nt, Artificial Sequence
  CIITA targeting sequence
cugaaaccuugagggcagcu

SEQ ID NO: 50593 - RNA, 20 nt, Artificial Sequence
  CIITA targeting sequence
auugcacguucguauugaag

SEQ ID NO: 50594 - RNA, 20 nt, Artificial Sequence
  CIITA targeting sequence
uauugaagagcagggaacug

SEQ ID NO: 50595 - RNA, 20 nt, Artificial Sequence
  CIITA targeting sequence
auacgaacgugcaauggagg

SEQ ID NO: 50596 - RNA, 20 nt, Artificial Sequence
  CIITA targeting sequence
ucaauacgaacgugcaaugg

SEQ ID NO: 50597 - RNA, 20 nt, Artificial Sequence
  CIITA targeting sequence
cugcucuucaauacgaacgu

SEQ ID NO: 50598 - RNA, 20 nt, Artificial Sequence
  CIITA targeting sequence
guucccugcucuucaauacg

SEQ ID NO: 50599 - RNA, 20 nt, Artificial Sequence
  CIITA targeting sequence
uuuucaguucccugcucuuc

SEQ ID NO: 50600 - RNA, 20 nt, Artificial Sequence
  CIITA targeting sequence
caguaucuuuuucaguuccc

SEQ ID NO: 50601 - RNA, 20 nt, Artificial Sequence
  CIITA targeting sequence
uuucccaguaucuuuuucag

SEQ ID NO: 50602 - RNA, 20 nt, Artificial Sequence
  CIITA targeting sequence
ucauuucccaguaucuuuuu

SEQ ID NO: 50603 - RNA, 20 nt, Artificial Sequence
  CIITA targeting sequence
aagggucuucauuucccagu

SEQ ID NO: 50604 - RNA, 20 nt, Artificial Sequence
  CIITA targeting sequence
augucuguggcaggacgugu

SEQ ID NO: 50605 - RNA, 20 nt, Artificial Sequence
  CIITA targeting sequence
guggcaggacguguggacag

SEQ ID NO: 50606 - RNA, 20 nt, Artificial Sequence
  CIITA targeting sequence
ugccacagacauggagcuuc

SEQ ID NO: 50607 - RNA, 20 nt, Artificial Sequence
  CIITA targeting sequence
acacguccugccacagacau

SEQ ID NO: 50608 - RNA, 20 nt, Artificial Sequence
  CIITA targeting sequence
ccuguccacacguccugcca

SEQ ID NO: 50609 - RNA, 20 nt, Artificial Sequence
  CIITA targeting sequence
caacaagccuccccugucca

SEQ ID NO: 50610 - RNA, 20 nt, Artificial Sequence
  CIITA targeting sequence
ggcuguccuuguaagauccc

SEQ ID NO: 50611 - RNA, 20 nt, Artificial Sequence
  CIITA targeting sequence
uuguaagaucccaaagccag

SEQ ID NO: 50612 - RNA, 20 nt, Artificial Sequence
  CIITA targeting sequence
uacaaggacagccagauccc

SEQ ID NO: 50613 - RNA, 20 nt, Artificial Sequence
  CIITA targeting sequence
caaagccagcaucggaagcg

SEQ ID NO: 50614 - RNA, 20 nt, Artificial Sequence
  CIITA targeting sequence
gaagcgucgucugagaggau

SEQ ID NO: 50615 - RNA, 20 nt, Artificial Sequence
  CIITA targeting sequence
gaugcuggcuuugggaucuu

SEQ ID NO: 50616 - RNA, 20 nt, Artificial Sequence
  CIITA targeting sequence
ucugagaggaucccugugac

SEQ ID NO: 50617 - RNA, 20 nt, Artificial Sequence
  CIITA targeting sequence
gagaggaucccugugaccuc

SEQ ID NO: 50618 - RNA, 20 nt, Artificial Sequence
  CIITA targeting sequence
gacgacgcuuccgaugcugg

SEQ ID NO: 50619 - RNA, 20 nt, Artificial Sequence
  CIITA targeting sequence
cagacgacgcuuccgaugcu

SEQ ID NO: 50620 - RNA, 20 nt, Artificial Sequence
  CIITA targeting sequence
ucucagacgacgcuuccgau

SEQ ID NO: 50621 - RNA, 20 nt, Artificial Sequence
  CIITA targeting sequence
cugugaccuccugacugcag

SEQ ID NO: 50622 - RNA, 20 nt, Artificial Sequence
  CIITA targeting sequence
cagggauccucucagacgac

SEQ ID NO: 50623 - RNA, 20 nt, Artificial Sequence
  CIITA targeting sequence
ugacugcagagaaagcaggc

SEQ ID NO: 50624 - RNA, 20 nt, Artificial Sequence
  CIITA targeting sequence
ggaggucacagggauccucu

SEQ ID NO: 50625 - RNA, 20 nt, Artificial Sequence
  CIITA targeting sequence
gcagucaggaggucacaggg

SEQ ID NO: 50626 - RNA, 20 nt, Artificial Sequence
  CIITA targeting sequence
cugcagucaggaggucacag

SEQ ID NO: 50627 - RNA, 20 nt, Artificial Sequence
  CIITA targeting sequence
aggaagcaagcagggggaug

SEQ ID NO: 50628 - RNA, 20 nt, Artificial Sequence
  CIITA targeting sequence
uggaagcuggcagccugcuu

SEQ ID NO: 50629 - RNA, 20 nt, Artificial Sequence
  CIITA targeting sequence
cccugcuugcuuccuggaag

SEQ ID NO: 50630 - RNA, 20 nt, Artificial Sequence
  CIITA targeting sequence
cccugacaggcacguggccu

SEQ ID NO: 50631 - RNA, 20 nt, Artificial Sequence
  CIITA targeting sequence
cugacaggcacguggccuuu

SEQ ID NO: 50632 - RNA, 20 nt, Artificial Sequence
  CIITA targeting sequence
gggagacgccccuggcccca

SEQ ID NO: 50633 - RNA, 20 nt, Artificial Sequence
  CIITA targeting sequence
cuucccuccuuguuucagga

SEQ ID NO: 50634 - RNA, 20 nt, Artificial Sequence
  CIITA targeting sequence
cuccuuguuucaggacugac

SEQ ID NO: 50635 - RNA, 20 nt, Artificial Sequence
  CIITA targeting sequence
uuguuucaggacugacccac

SEQ ID NO: 50636 - RNA, 20 nt, Artificial Sequence
  CIITA targeting sequence
ggacugacccaccccaauuc

SEQ ID NO: 50637 - RNA, 20 nt, Artificial Sequence
  CIITA targeting sequence
ugaaacaaggagggaaggga

SEQ ID NO: 50638 - RNA, 20 nt, Artificial Sequence
  CIITA targeting sequence
guccugaaacaaggagggaa

SEQ ID NO: 50639 - RNA, 20 nt, Artificial Sequence
  CIITA targeting sequence
cuuugcuguccucaaacucu

SEQ ID NO: 50640 - RNA, 20 nt, Artificial Sequence
  CIITA targeting sequence
ucaaacucuaagccuccagc

SEQ ID NO: 50641 - RNA, 20 nt, Artificial Sequence
  CIITA targeting sequence
aacucuaagccuccagcaca

SEQ ID NO: 50642 - RNA, 20 nt, Artificial Sequence
  CIITA targeting sequence
aagccuccagcacagguuuu

SEQ ID NO: 50643 - RNA, 20 nt, Artificial Sequence
  CIITA targeting sequence
agcacagguuuuauuuagau

SEQ ID NO: 50644 - RNA, 20 nt, Artificial Sequence
  CIITA targeting sequence
aaauaaaaccugugcuggag

SEQ ID NO: 50645 - RNA, 20 nt, Artificial Sequence
  CIITA targeting sequence
uaaauauacuaucuaaauaa

SEQ ID NO: 50646 - RNA, 20 nt, Artificial Sequence
  CIITA targeting sequence
acacccaucauaaauauacu

SEQ ID NO: 50647 - RNA, 20 nt, Artificial Sequence
  CIITA targeting sequence
uuaucaacacccaucauaaa

SEQ ID NO: 50648 - RNA, 20 nt, Artificial Sequence
  CIITA targeting sequence
aaucuuuaucaacacccauc

SEQ ID NO: 50649 - RNA, 20 nt, Artificial Sequence
  CIITA targeting sequence
caacuuaccccuuggcaccc

SEQ ID NO: 50650 - RNA, 20 nt, Artificial Sequence
  CIITA targeting sequence
gaugccaggugguagggugu

SEQ ID NO: 50651 - RNA, 20 nt, Artificial Sequence
  CIITA targeting sequence
gaggggugccaagggguaag

SEQ ID NO: 50652 - RNA, 20 nt, Artificial Sequence
  CIITA targeting sequence
cacccuaccaccuggcaucc

SEQ ID NO: 50653 - RNA, 20 nt, Artificial Sequence
  CIITA targeting sequence
uuuucacacccuaccaccug

SEQ ID NO: 50654 - RNA, 20 nt, Artificial Sequence
  CIITA targeting sequence
gguucauuuucacacccuac

SEQ ID NO: 50655 - RNA, 20 nt, Artificial Sequence
  CIITA targeting sequence
accagcaggucugguucauu

SEQ ID NO: 50656 - RNA, 20 nt, Artificial Sequence
  CIITA targeting sequence
ucaaccagcaggucugguuc

SEQ ID NO: 50657 - RNA, 20 nt, Artificial Sequence
  CIITA targeting sequence
auaauuagcaggucuucaac

SEQ ID NO: 50658 - RNA, 20 nt, Artificial Sequence
  CIITA targeting sequence
ggcgcugaaucuaaaucagg

SEQ ID NO: 50659 - RNA, 20 nt, Artificial Sequence
  CIITA targeting sequence
gcgccugacacauaguaguu

SEQ ID NO: 50660 - RNA, 20 nt, Artificial Sequence
  CIITA targeting sequence
aaaucaggguuuugccaugc

SEQ ID NO: 50661 - RNA, 20 nt, Artificial Sequence
  CIITA targeting sequence
ggguuuugccaugcagggaa

SEQ ID NO: 50662 - RNA, 20 nt, Artificial Sequence
  CIITA targeting sequence
cugcauggcaaaacccugau

SEQ ID NO: 50663 - RNA, 20 nt, Artificial Sequence
  CIITA targeting sequence
gggcaugucuggagacauuu

SEQ ID NO: 50664 - RNA, 20 nt, Artificial Sequence
  CIITA targeting sequence
ggagacauuuucaguguuac

SEQ ID NO: 50665 - RNA, 20 nt, Artificial Sequence
  CIITA targeting sequence
agacaugcccagauguuccc

SEQ ID NO: 50666 - RNA, 20 nt, Artificial Sequence
  CIITA targeting sequence
ccagacaugcccagauguuc

SEQ ID NO: 50667 - RNA, 20 nt, Artificial Sequence
  CIITA targeting sequence
guguuacaaaucgcuguagg

SEQ ID NO: 50668 - RNA, 20 nt, Artificial Sequence
  CIITA targeting sequence
cuguagggguggguacuacu

SEQ ID NO: 50669 - RNA, 20 nt, Artificial Sequence
  CIITA targeting sequence
aguggguagaggccagggau

SEQ ID NO: 50670 - RNA, 20 nt, Artificial Sequence
  CIITA targeting sequence
acccacuagauaccaguagu

SEQ ID NO: 50671 - RNA, 20 nt, Artificial Sequence
  CIITA targeting sequence
cuggccucuacccacuagau

SEQ ID NO: 50672 - RNA, 20 nt, Artificial Sequence
  CIITA targeting sequence
uaaagugcacagugcagccu

SEQ ID NO: 50673 - RNA, 20 nt, Artificial Sequence
  CIITA targeting sequence
cauaccaggcucugaaugug

SEQ ID NO: 50674 - RNA, 20 nt, Artificial Sequence
  CIITA targeting sequence
gaaugugaauagagccaagg

SEQ ID NO: 50675 - RNA, 20 nt, Artificial Sequence
  CIITA targeting sequence
gagccugguaugggaggcug

SEQ ID NO: 50676 - RNA, 20 nt, Artificial Sequence
  CIITA targeting sequence
cauucagagccugguauggg

SEQ ID NO: 50677 - RNA, 20 nt, Artificial Sequence
  CIITA targeting sequence
auucacauucagagccuggu

SEQ ID NO: 50678 - RNA, 20 nt, Artificial Sequence
  CIITA targeting sequence
agaaacccugcucuagaaag

SEQ ID NO: 50679 - RNA, 20 nt, Artificial Sequence
  CIITA targeting sequence
ugaccuuggcucuauucaca

SEQ ID NO: 50680 - RNA, 20 nt, Artificial Sequence
  CIITA targeting sequence
agaaagaugaaagacacauu

SEQ ID NO: 50681 - RNA, 20 nt, Artificial Sequence
  CIITA targeting sequence
agagcaggguuucuugaccu

SEQ ID NO: 50682 - RNA, 20 nt, Artificial Sequence
  CIITA targeting sequence
uucuagagcaggguuucuug

SEQ ID NO: 50683 - RNA, 20 nt, Artificial Sequence
  CIITA targeting sequence
ucuuucuagagcaggguuuc

SEQ ID NO: 50684 - RNA, 20 nt, Artificial Sequence
  CIITA targeting sequence
uucaucuuucuagagcaggg

SEQ ID NO: 50685 - RNA, 20 nt, Artificial Sequence
  CIITA targeting sequence
cugacuucacaggacaggag

SEQ ID NO: 50686 - RNA, 20 nt, Artificial Sequence
  CIITA targeting sequence
gggaaugugucuuucaucuu

SEQ ID NO: 50687 - RNA, 20 nt, Artificial Sequence
  CIITA targeting sequence
caggacaggaguaaagaauu

SEQ ID NO: 50688 - RNA, 20 nt, Artificial Sequence
  CIITA targeting sequence
ugugaagucagggaaugugu

SEQ ID NO: 50689 - RNA, 20 nt, Artificial Sequence
  CIITA targeting sequence
uguccugugaagucagggaa

SEQ ID NO: 50690 - RNA, 20 nt, Artificial Sequence
  CIITA targeting sequence
uuacuccuguccugugaagu

SEQ ID NO: 50691 - RNA, 20 nt, Artificial Sequence
  CIITA targeting sequence
gguuccagccgggcacacug

SEQ ID NO: 50692 - RNA, 20 nt, Artificial Sequence
  CIITA targeting sequence
agccgggcacacuggcucac

SEQ ID NO: 50693 - RNA, 20 nt, Artificial Sequence
  CIITA targeting sequence
cgcccauaaucccagcacuu

SEQ ID NO: 50694 - RNA, 20 nt, Artificial Sequence
  CIITA targeting sequence
cagcacuuugggaggcugag

SEQ ID NO: 50695 - RNA, 20 nt, Artificial Sequence
  CIITA targeting sequence
caaagugcugggauuauggg

SEQ ID NO: 50696 - RNA, 20 nt, Artificial Sequence
  CIITA targeting sequence
gccucccaaagugcugggau

SEQ ID NO: 50697 - RNA, 20 nt, Artificial Sequence
  CIITA targeting sequence
gcccaccucagccucccaaa

SEQ ID NO: 50698 - RNA, 20 nt, Artificial Sequence
  CIITA targeting sequence
uuugaggucaggaguucaag

SEQ ID NO: 50699 - RNA, 20 nt, Artificial Sequence
  CIITA targeting sequence
aacgaucugcccaccucagc

SEQ ID NO: 50700 - RNA, 20 nt, Artificial Sequence
  CIITA targeting sequence
ggaguucaagaccagccugg

SEQ ID NO: 50701 - RNA, 20 nt, Artificial Sequence
  CIITA targeting sequence
ugaccucaaacgaucugccc

SEQ ID NO: 50702 - RNA, 20 nt, Artificial Sequence
  CIITA targeting sequence
agaccagccuggucaacaua

SEQ ID NO: 50703 - RNA, 20 nt, Artificial Sequence
  CIITA targeting sequence
ugaacuccugaccucaaacg

SEQ ID NO: 50704 - RNA, 20 nt, Artificial Sequence
  CIITA targeting sequence
acauaaaugaaaccccaucu

SEQ ID NO: 50705 - RNA, 20 nt, Artificial Sequence
  CIITA targeting sequence
uuuauguugaccaggcuggu

SEQ ID NO: 50706 - RNA, 20 nt, Artificial Sequence
  CIITA targeting sequence
cuacuaaaaaugccccccaa

SEQ ID NO: 50707 - RNA, 20 nt, Artificial Sequence
  CIITA targeting sequence
acuaaaaaugccccccaaaa

SEQ ID NO: 50708 - RNA, 20 nt, Artificial Sequence
  CIITA targeting sequence
caacugcuugggaggcugag

SEQ ID NO: 50709 - RNA, 20 nt, Artificial Sequence
  CIITA targeting sequence
caagcaguugggauuacagg

SEQ ID NO: 50710 - RNA, 20 nt, Artificial Sequence
  CIITA targeting sequence
gccucccaagcaguugggau

SEQ ID NO: 50711 - RNA, 20 nt, Artificial Sequence
  CIITA targeting sequence
ugccucagccucccaagcag

SEQ ID NO: 50712 - RNA, 20 nt, Artificial Sequence
  CIITA targeting sequence
ccugccucagccucccaagc

SEQ ID NO: 50713 - RNA, 20 nt, Artificial Sequence
  CIITA targeting sequence
cuugaaccugggagauggag

SEQ ID NO: 50714 - RNA, 20 nt, Artificial Sequence
  CIITA targeting sequence
agugauucuccugccucagc

SEQ ID NO: 50715 - RNA, 20 nt, Artificial Sequence
  CIITA targeting sequence
cagguucaagugauucuccu

SEQ ID NO: 50716 - RNA, 20 nt, Artificial Sequence
  CIITA targeting sequence
cccagguucaagugauucuc

SEQ ID NO: 50717 - RNA, 20 nt, Artificial Sequence
  CIITA targeting sequence
aucucccagguucaagugau

SEQ ID NO: 50718 - RNA, 20 nt, Artificial Sequence
  CIITA targeting sequence
accuccaucucccagguuca

SEQ ID NO: 50719 - RNA, 20 nt, Artificial Sequence
  CIITA targeting sequence
cuuccaccuccaucucccag

SEQ ID NO: 50720 - RNA, 20 nt, Artificial Sequence
  CIITA targeting sequence
uggcucacuuccaccuccau

SEQ ID NO: 50721 - RNA, 20 nt, Artificial Sequence
  CIITA targeting sequence
uuccaugaacuccagccugg

SEQ ID NO: 50722 - RNA, 20 nt, Artificial Sequence
  CIITA targeting sequence
augaacuccagccuggguga

SEQ ID NO: 50723 - RNA, 20 nt, Artificial Sequence
  CIITA targeting sequence
uggaaugaucuuggcucacu

SEQ ID NO: 50724 - RNA, 20 nt, Artificial Sequence
  CIITA targeting sequence
agccugggugacagagcgag

SEQ ID NO: 50725 - RNA, 20 nt, Artificial Sequence
  CIITA targeting sequence
cccaggcuggaguucaugga

SEQ ID NO: 50726 - RNA, 20 nt, Artificial Sequence
  CIITA targeting sequence
gucacccaggcuggaguuca

SEQ ID NO: 50727 - RNA, 20 nt, Artificial Sequence
  CIITA targeting sequence
cucugucacccaggcuggag

SEQ ID NO: 50728 - RNA, 20 nt, Artificial Sequence
  CIITA targeting sequence
cgcucugucacccaggcugg

SEQ ID NO: 50729 - RNA, 20 nt, Artificial Sequence
  CIITA targeting sequence
gcugagagagagagagaagg

SEQ ID NO: 50730 - RNA, 20 nt, Artificial Sequence
  CIITA targeting sequence
gcagagucucgcucugucac

SEQ ID NO: 50731 - RNA, 20 nt, Artificial Sequence
  CIITA targeting sequence
cagcagagucucgcucuguc

SEQ ID NO: 50732 - RNA, 20 nt, Artificial Sequence
  CIITA targeting sequence
cucagcagagucucgcucug

SEQ ID NO: 50733 - RNA, 20 nt, Artificial Sequence
  CIITA targeting sequence
cucucagcagagucucgcuc

SEQ ID NO: 50734 - RNA, 20 nt, Artificial Sequence
  CIITA targeting sequence
cucucucagcagagucucgc

SEQ ID NO: 50735 - RNA, 20 nt, Artificial Sequence
  CIITA targeting sequence
cucucucucagcagagucuc

SEQ ID NO: 50736 - RNA, 20 nt, Artificial Sequence
  CIITA targeting sequence
cucucucucucagcagaguc

SEQ ID NO: 50737 - RNA, 20 nt, Artificial Sequence
  CIITA targeting sequence
uucucucucucucucagcag

SEQ ID NO: 50738 - RNA, 20 nt, Artificial Sequence
  CIITA targeting sequence
uccuucucucucucucucag

SEQ ID NO: 50739 - RNA, 20 nt, Artificial Sequence
  CIITA targeting sequence
ucuuccuucucucucucucu

SEQ ID NO: 50740 - RNA, 20 nt, Artificial Sequence
  CIITA targeting sequence
uuuacuuuuucuucuuccuu

SEQ ID NO: 50741 - RNA, 20 nt, Artificial Sequence
  CIITA targeting sequence
ucuuuuacuuuuucuucuuc

SEQ ID NO: 50742 - RNA, 20 nt, Artificial Sequence
  CIITA targeting sequence
ucuucuuuuacuuuuucuuc

SEQ ID NO: 50743 - RNA, 20 nt, Artificial Sequence
  CIITA targeting sequence
ucuucuucuuuuacuuuuuc

SEQ ID NO: 50744 - RNA, 20 nt, Artificial Sequence
  CIITA targeting sequence
uucuucuucuucuuuuacuu

SEQ ID NO: 50745 - RNA, 20 nt, Artificial Sequence
  CIITA targeting sequence
uccuucuucuucuucuuuua

SEQ ID NO: 50746 - RNA, 20 nt, Artificial Sequence
  CIITA targeting sequence
uccuccuucuucuucuucuu

SEQ ID NO: 50747 - RNA, 20 nt, Artificial Sequence
  CIITA targeting sequence
uccuccuccuucuucuucuu

SEQ ID NO: 50748 - RNA, 20 nt, Artificial Sequence
  CIITA targeting sequence
uccuccuccuccuucuucuu

SEQ ID NO: 50749 - RNA, 20 nt, Artificial Sequence
  CIITA targeting sequence
uccuccuccuccuccuucuu

SEQ ID NO: 50750 - RNA, 20 nt, Artificial Sequence
  CIITA targeting sequence
uccuccuccuccuccuccuu

SEQ ID NO: 50751 - RNA, 20 nt, Artificial Sequence
  CIITA targeting sequence
uccuccuccuccuccuccuc

SEQ ID NO: 50752 - RNA, 20 nt, Artificial Sequence
  CIITA targeting sequence
uccuccuccuccuccuccuc

SEQ ID NO: 50753 - RNA, 20 nt, Artificial Sequence
  CIITA targeting sequence
uccuccuccuccuccuccuc

SEQ ID NO: 50754 - RNA, 20 nt, Artificial Sequence
  CIITA targeting sequence
uccuccuccuccuccuccuc

SEQ ID NO: 50755 - RNA, 20 nt, Artificial Sequence
  CIITA targeting sequence
uccuccuccuccuccuccuc

SEQ ID NO: 50756 - RNA, 20 nt, Artificial Sequence
  CIITA targeting sequence
ccccugccccuccuccuccu

SEQ ID NO: 50757 - RNA, 20 nt, Artificial Sequence
  CIITA targeting sequence
uccccccugccccuccuccu

SEQ ID NO: 50758 - RNA, 20 nt, Artificial Sequence
  CIITA targeting sequence
uccuccccccugccccuccu

SEQ ID NO: 50759 - RNA, 20 nt, Artificial Sequence
  CIITA targeting sequence
cccuccuccuccccccugcc

SEQ ID NO: 50760 - RNA, 20 nt, Artificial Sequence
  CIITA targeting sequence
ccccucccccuccuccuccc

SEQ ID NO: 50761 - RNA, 20 nt, Artificial Sequence
  CIITA targeting sequence
uccccccucccccuccuccu

SEQ ID NO: 50762 - RNA, 20 nt, Artificial Sequence
  CIITA targeting sequence
uccuccccccucccccuccu

SEQ ID NO: 50763 - RNA, 20 nt, Artificial Sequence
  CIITA targeting sequence
ccccuccuccuccccccucc

SEQ ID NO: 50764 - RNA, 20 nt, Artificial Sequence
  CIITA targeting sequence
uccccccuccuccucccccc

SEQ ID NO: 50765 - RNA, 20 nt, Artificial Sequence
  CIITA targeting sequence
uccuccccccuccuccuccc

SEQ ID NO: 50766 - RNA, 20 nt, Artificial Sequence
  CIITA targeting sequence
cccuccuccuccccccuccu

SEQ ID NO: 50767 - RNA, 20 nt, Artificial Sequence
  CIITA targeting sequence
cccucgcccuccuccucccc

SEQ ID NO: 50768 - RNA, 20 nt, Artificial Sequence
  CIITA targeting sequence
cccucccccucgcccuccuc

SEQ ID NO: 50769 - RNA, 20 nt, Artificial Sequence
  CIITA targeting sequence
cucccccucccccucgcccu

SEQ ID NO: 50770 - RNA, 20 nt, Artificial Sequence
  CIITA targeting sequence
cucccucccccucccccucg

SEQ ID NO: 50771 - RNA, 20 nt, Artificial Sequence
  CIITA targeting sequence
cccucccucccccucccccu

SEQ ID NO: 50772 - RNA, 20 nt, Artificial Sequence
  CIITA targeting sequence
cucccucccucccccucccc

SEQ ID NO: 50773 - RNA, 20 nt, Artificial Sequence
  CIITA targeting sequence
acuucucucccucccucccc

SEQ ID NO: 50774 - RNA, 20 nt, Artificial Sequence
  CIITA targeting sequence
ucuacuucucucccucccuc

SEQ ID NO: 50775 - RNA, 20 nt, Artificial Sequence
  CIITA targeting sequence
ucuucuacuucucucccucc

SEQ ID NO: 50776 - RNA, 20 nt, Artificial Sequence
  CIITA targeting sequence
ucuucuucuacuucucuccc

SEQ ID NO: 50777 - RNA, 20 nt, Artificial Sequence
  CIITA targeting sequence
uuacucuucuucuucuacuu

SEQ ID NO: 50778 - RNA, 20 nt, Artificial Sequence
  CIITA targeting sequence
uucuuuacucuucuucuucu

SEQ ID NO: 50779 - RNA, 20 nt, Artificial Sequence
  CIITA targeting sequence
uuccuucuuuacucuucuuc

SEQ ID NO: 50780 - RNA, 20 nt, Artificial Sequence
  CIITA targeting sequence
uccuuccuucuuuacucuuc

SEQ ID NO: 50781 - RNA, 20 nt, Artificial Sequence
  CIITA targeting sequence
uuucuuccuuccuucuuuac

SEQ ID NO: 50782 - RNA, 20 nt, Artificial Sequence
  CIITA targeting sequence
cuuuucuuccuuccuucuuu

SEQ ID NO: 50783 - RNA, 20 nt, Artificial Sequence
  CIITA targeting sequence
uucucuuuucuuccuuccuu

SEQ ID NO: 50784 - RNA, 20 nt, Artificial Sequence
  CIITA targeting sequence
uuucuuucucuuuucuuccu

SEQ ID NO: 50785 - RNA, 20 nt, Artificial Sequence
  CIITA targeting sequence
uucuuuucuuucucuuuucu

SEQ ID NO: 50786 - RNA, 20 nt, Artificial Sequence
  CIITA targeting sequence
uucuuucuuuucuuucucuu

SEQ ID NO: 50787 - RNA, 20 nt, Artificial Sequence
  CIITA targeting sequence
uuuuucuuucuuucuuuucu

SEQ ID NO: 50788 - RNA, 20 nt, Artificial Sequence
  CIITA targeting sequence
uucuuuuuucuuucuuucuu

SEQ ID NO: 50789 - RNA, 20 nt, Artificial Sequence
  CIITA targeting sequence
uucuuucuuuuuucuuucuu

SEQ ID NO: 50790 - RNA, 20 nt, Artificial Sequence
  CIITA targeting sequence
uuuucuuucuuucuuuuuuc

SEQ ID NO: 50791 - RNA, 20 nt, Artificial Sequence
  CIITA targeting sequence
uucuuuuucuuucuuucuuu

SEQ ID NO: 50792 - RNA, 20 nt, Artificial Sequence
  CIITA targeting sequence
uucuuucuuuuucuuucuuu

SEQ ID NO: 50793 - RNA, 20 nt, Artificial Sequence
  CIITA targeting sequence
uuuuuucuuucuuucuuuuu

SEQ ID NO: 50794 - RNA, 20 nt, Artificial Sequence
  CIITA targeting sequence
uucuuuuuuucuuucuuucu

SEQ ID NO: 50795 - RNA, 20 nt, Artificial Sequence
  CIITA targeting sequence
agcaagaugaaagacacauu

SEQ ID NO: 50796 - RNA, 20 nt, Artificial Sequence
  CIITA targeting sequence
ugcuagagcagggucuuucu

SEQ ID NO: 50797 - RNA, 20 nt, Artificial Sequence
  CIITA targeting sequence
ucuugcuagagcagggucuu

SEQ ID NO: 50798 - RNA, 20 nt, Artificial Sequence
  CIITA targeting sequence
uucaucuugcuagagcaggg

SEQ ID NO: 50799 - RNA, 20 nt, Artificial Sequence
  CIITA targeting sequence
cuggcuucauaggaaagggg

SEQ ID NO: 50800 - RNA, 20 nt, Artificial Sequence
  CIITA targeting sequence
uaggaaaggggcaaauaauu

SEQ ID NO: 50801 - RNA, 20 nt, Artificial Sequence
  CIITA targeting sequence
uaugaagccagggaaugugu

SEQ ID NO: 50802 - RNA, 20 nt, Artificial Sequence
  CIITA targeting sequence
aguucuggccaggcacagug

SEQ ID NO: 50803 - RNA, 20 nt, Artificial Sequence
  CIITA targeting sequence
ggccaggcacaguggcucgc

SEQ ID NO: 50804 - RNA, 20 nt, Artificial Sequence
  CIITA targeting sequence
caccuguaaucccagcacuu

SEQ ID NO: 50805 - RNA, 20 nt, Artificial Sequence
  CIITA targeting sequence
cagcacuuugggaggaugag

SEQ ID NO: 50806 - RNA, 20 nt, Artificial Sequence
  CIITA targeting sequence
caaagugcugggauuacagg

SEQ ID NO: 50807 - RNA, 20 nt, Artificial Sequence
  CIITA targeting sequence
ucccaaagugcugggauuac

SEQ ID NO: 50808 - RNA, 20 nt, Artificial Sequence
  CIITA targeting sequence
uccucccaaagugcugggau

SEQ ID NO: 50809 - RNA, 20 nt, Artificial Sequence
  CIITA targeting sequence
caccucauccucccaaagug

SEQ ID NO: 50810 - RNA, 20 nt, Artificial Sequence
  CIITA targeting sequence
ucccaccucauccucccaaa

SEQ ID NO: 50811 - RNA, 20 nt, Artificial Sequence
  CIITA targeting sequence
aggcauccucccaccucauc

SEQ ID NO: 50812 - RNA, 20 nt, Artificial Sequence
  CIITA targeting sequence
uggguucaaggcauccuccc

SEQ ID NO: 50813 - RNA, 20 nt, Artificial Sequence
  CIITA targeting sequence
gagaccagccugggcaacau

SEQ ID NO: 50814 - RNA, 20 nt, Artificial Sequence
  CIITA targeting sequence
gacuccuggguucaaggcau

SEQ ID NO: 50815 - RNA, 20 nt, Artificial Sequence
  CIITA targeting sequence
cagacuccuggguucaaggc

SEQ ID NO: 50816 - RNA, 20 nt, Artificial Sequence
  CIITA targeting sequence
agaccuugucucuaucaaaa

SEQ ID NO: 50817 - RNA, 20 nt, Artificial Sequence
  CIITA targeting sequence
ugauauguugcccaggcugg

SEQ ID NO: 50818 - RNA, 20 nt, Artificial Sequence
  CIITA targeting sequence
cuaucaaaaaaagaagagaa

SEQ ID NO: 50819 - RNA, 20 nt, Artificial Sequence
  CIITA targeting sequence
aucaaaaaaagaagagaaaa

SEQ ID NO: 50820 - RNA, 20 nt, Artificial Sequence
  CIITA targeting sequence
aaaaaagaagagaaaagaaa

SEQ ID NO: 50821 - RNA, 20 nt, Artificial Sequence
  CIITA targeting sequence
uuuuuugauagagacaaggu

SEQ ID NO: 50822 - RNA, 20 nt, Artificial Sequence
  CIITA targeting sequence
ucuuuuuuugauagagacaa

SEQ ID NO: 50823 - RNA, 20 nt, Artificial Sequence
  CIITA targeting sequence
cuucuuuuuuugauagagac

SEQ ID NO: 50824 - RNA, 20 nt, Artificial Sequence
  CIITA targeting sequence
uuucucuucuuuuuuugaua

SEQ ID NO: 50825 - RNA, 20 nt, Artificial Sequence
  CIITA targeting sequence
uuucuuuucucuucuuuuuu

SEQ ID NO: 50826 - RNA, 20 nt, Artificial Sequence
  CIITA targeting sequence
cuuuucuuuucucuucuuuu

SEQ ID NO: 50827 - RNA, 20 nt, Artificial Sequence
  CIITA targeting sequence
agauccucagcaucugcuau

SEQ ID NO: 50828 - RNA, 20 nt, Artificial Sequence
  CIITA targeting sequence
agaaauuauuuuuuuucucu

SEQ ID NO: 50829 - RNA, 20 nt, Artificial Sequence
  CIITA targeting sequence
ucagcaucugcuauguucca

SEQ ID NO: 50830 - RNA, 20 nt, Artificial Sequence
  CIITA targeting sequence
gcaucugcuauguuccaggg

SEQ ID NO: 50831 - RNA, 20 nt, Artificial Sequence
  CIITA targeting sequence
gcuauguuccaggggcagga

SEQ ID NO: 50832 - RNA, 20 nt, Artificial Sequence
  CIITA targeting sequence
aggggcaggaggaagcucug

SEQ ID NO: 50833 - RNA, 20 nt, Artificial Sequence
  CIITA targeting sequence
ugccccuggaacauagcaga

SEQ ID NO: 50834 - RNA, 20 nt, Artificial Sequence
  CIITA targeting sequence
uccugccccuggaacauagc

SEQ ID NO: 50835 - RNA, 20 nt, Artificial Sequence
  CIITA targeting sequence
gucuucacuuuggcagcaag

SEQ ID NO: 50836 - RNA, 20 nt, Artificial Sequence
  CIITA targeting sequence
ucacuuuggcagcaagccug

SEQ ID NO: 50837 - RNA, 20 nt, Artificial Sequence
  CIITA targeting sequence
cuuuggcagcaagccuguag

SEQ ID NO: 50838 - RNA, 20 nt, Artificial Sequence
  CIITA targeting sequence
cagcccguuuugcuggaggg

SEQ ID NO: 50839 - RNA, 20 nt, Artificial Sequence
  CIITA targeting sequence
gcccguuuugcuggaggggg

SEQ ID NO: 50840 - RNA, 20 nt, Artificial Sequence
  CIITA targeting sequence
agcaaaacgggcugagaaug

SEQ ID NO: 50841 - RNA, 20 nt, Artificial Sequence
  CIITA targeting sequence
aaugcccccuccagcaaaac

SEQ ID NO: 50842 - RNA, 20 nt, Artificial Sequence
  CIITA targeting sequence
uuguaggcuggcuaagcugg

SEQ ID NO: 50843 - RNA, 20 nt, Artificial Sequence
  CIITA targeting sequence
ccccaguaacacuccuugua

SEQ ID NO: 50844 - RNA, 20 nt, Artificial Sequence
  CIITA targeting sequence
ccgcuggcuguuuucacccc

SEQ ID NO: 50845 - RNA, 20 nt, Artificial Sequence
  CIITA targeting sequence
gcuuguggcccgccaggugc

SEQ ID NO: 50846 - RNA, 20 nt, Artificial Sequence
  CIITA targeting sequence
caggcaccuggcgggccaca

SEQ ID NO: 50847 - RNA, 20 nt, Artificial Sequence
  CIITA targeting sequence
ccaucccaggcaccuggcgg

SEQ ID NO: 50848 - RNA, 20 nt, Artificial Sequence
  CIITA targeting sequence
ugcccaacccccuccucccu

SEQ ID NO: 50849 - RNA, 20 nt, Artificial Sequence
  CIITA targeting sequence
ucccucuucauggggggaac

SEQ ID NO: 50850 - RNA, 20 nt, Artificial Sequence
  CIITA targeting sequence
cucuucauggggggaacugg

SEQ ID NO: 50851 - RNA, 20 nt, Artificial Sequence
  CIITA targeting sequence
ucauggggggaacugggggu

SEQ ID NO: 50852 - RNA, 20 nt, Artificial Sequence
  CIITA targeting sequence
uggggggaacuggggguggc

SEQ ID NO: 50853 - RNA, 20 nt, Artificial Sequence
  CIITA targeting sequence
ccccaugaagagggaggagg

SEQ ID NO: 50854 - RNA, 20 nt, Artificial Sequence
  CIITA targeting sequence
cacccggcagccgcugccac

SEQ ID NO: 50855 - RNA, 20 nt, Artificial Sequence
  CIITA targeting sequence
ggccuguggcccugccugac

SEQ ID NO: 50856 - RNA, 20 nt, Artificial Sequence
  CIITA targeting sequence
ggcagggccacaggccugag

SEQ ID NO: 50857 - RNA, 20 nt, Artificial Sequence
  CIITA targeting sequence
ccaucaagccaugugacgag

SEQ ID NO: 50858 - RNA, 20 nt, Artificial Sequence
  CIITA targeting sequence
agccaugugacgagaccagg

SEQ ID NO: 50859 - RNA, 20 nt, Artificial Sequence
  CIITA targeting sequence
cauggcuugauggggaccaa

SEQ ID NO: 50860 - RNA, 20 nt, Artificial Sequence
  CIITA targeting sequence
ucacauggcuugauggggac

SEQ ID NO: 50861 - RNA, 20 nt, Artificial Sequence
  CIITA targeting sequence
cgucacauggcuugaugggg

SEQ ID NO: 50862 - RNA, 20 nt, Artificial Sequence
  CIITA targeting sequence
uguggccuggucucgucaca

SEQ ID NO: 50863 - RNA, 20 nt, Artificial Sequence
  CIITA targeting sequence
uucuuguggccuggucucgu

SEQ ID NO: 50864 - RNA, 20 nt, Artificial Sequence
  CIITA targeting sequence
acaagcguuaucguuuccug

SEQ ID NO: 50865 - RNA, 20 nt, Artificial Sequence
  CIITA targeting sequence
uuuccuggaacuccaacucg

SEQ ID NO: 50866 - RNA, 20 nt, Artificial Sequence
  CIITA targeting sequence
uggaacuccaacucggcgac

SEQ ID NO: 50867 - RNA, 20 nt, Artificial Sequence
  CIITA targeting sequence
aggaaacgauaacgcuuguu

SEQ ID NO: 50868 - RNA, 20 nt, Artificial Sequence
  CIITA targeting sequence
aacucggcgacuuccccgaa

SEQ ID NO: 50869 - RNA, 20 nt, Artificial Sequence
  CIITA targeting sequence
gcgacuuccccgaagaccgg

SEQ ID NO: 50870 - RNA, 20 nt, Artificial Sequence
  CIITA targeting sequence
ccgaguuggaguuccaggaa

SEQ ID NO: 50871 - RNA, 20 nt, Artificial Sequence
  CIITA targeting sequence
ccgaagaccggcugugccug

SEQ ID NO: 50872 - RNA, 20 nt, Artificial Sequence
  CIITA targeting sequence
gggaagucgccgaguuggag

SEQ ID NO: 50873 - RNA, 20 nt, Artificial Sequence
  CIITA targeting sequence
ucggggaagucgccgaguug

SEQ ID NO: 50874 - RNA, 20 nt, Artificial Sequence
  CIITA targeting sequence
ccgcugugcgcagcccgccc

SEQ ID NO: 50875 - RNA, 20 nt, Artificial Sequence
  CIITA targeting sequence
uccuccgcugccuccgcggc

SEQ ID NO: 50876 - RNA, 20 nt, Artificial Sequence
  CIITA targeting sequence
uccgcugccuccgcggccgc

SEQ ID NO: 50877 - RNA, 20 nt, Artificial Sequence
  CIITA targeting sequence
gcugccuccgcggccgcguc

SEQ ID NO: 50878 - RNA, 20 nt, Artificial Sequence
  CIITA targeting sequence
gcggccgcgucuaucucagu

SEQ ID NO: 50879 - RNA, 20 nt, Artificial Sequence
  CIITA targeting sequence
aucucagucugacuaccugg

SEQ ID NO: 50880 - RNA, 20 nt, Artificial Sequence
  CIITA targeting sequence
cagucugacuaccuggaagc

SEQ ID NO: 50881 - RNA, 20 nt, Artificial Sequence
  CIITA targeting sequence
gucugacuaccuggaagcag

SEQ ID NO: 50882 - RNA, 20 nt, Artificial Sequence
  CIITA targeting sequence
gacuaccuggaagcagcacu

SEQ ID NO: 50883 - RNA, 20 nt, Artificial Sequence
  CIITA targeting sequence
gacugagauagacgcggccg

SEQ ID NO: 50884 - RNA, 20 nt, Artificial Sequence
  CIITA targeting sequence
agguagucagacugagauag

SEQ ID NO: 50885 - RNA, 20 nt, Artificial Sequence
  CIITA targeting sequence
acccuccagcccagcggccc

SEQ ID NO: 50886 - RNA, 20 nt, Artificial Sequence
  CIITA targeting sequence
agcccagcggcccucggcuc

SEQ ID NO: 50887 - RNA, 20 nt, Artificial Sequence
  CIITA targeting sequence
gcucagcugccaggucaccg

SEQ ID NO: 50888 - RNA, 20 nt, Artificial Sequence
  CIITA targeting sequence
gcugccaggucaccggcaac

SEQ ID NO: 50889 - RNA, 20 nt, Artificial Sequence
  CIITA targeting sequence
ccggcaaccccgggagcggu

SEQ ID NO: 50890 - RNA, 20 nt, Artificial Sequence
  CIITA targeting sequence
cgggguugccggugaccugg

SEQ ID NO: 50891 - RNA, 20 nt, Artificial Sequence
  CIITA targeting sequence
gccagccucugugauguuca

SEQ ID NO: 50892 - RNA, 20 nt, Artificial Sequence
  CIITA targeting sequence
gugauguucaggccgggcug

SEQ ID NO: 50893 - RNA, 20 nt, Artificial Sequence
  CIITA targeting sequence
cagaggcuggcggagcagcc

SEQ ID NO: 50894 - RNA, 20 nt, Artificial Sequence
  CIITA targeting sequence
ggccgggcugcaccagcccg

SEQ ID NO: 50895 - RNA, 20 nt, Artificial Sequence
  CIITA targeting sequence
cgggcuggugcagcccggcc

SEQ ID NO: 50896 - RNA, 20 nt, Artificial Sequence
  CIITA targeting sequence
gggcaccuaggggucccggg

SEQ ID NO: 50897 - RNA, 20 nt, Artificial Sequence
  CIITA targeting sequence
ucuuguuucugccccugaac

SEQ ID NO: 50898 - RNA, 20 nt, Artificial Sequence
  CIITA targeting sequence
uguuucugccccugaacaag

SEQ ID NO: 50899 - RNA, 20 nt, Artificial Sequence
  CIITA targeting sequence
gccccugaacaagcuucuca

SEQ ID NO: 50900 - RNA, 20 nt, Artificial Sequence
  CIITA targeting sequence
ggggcagaaacaagaggaag

SEQ ID NO: 50901 - RNA, 20 nt, Artificial Sequence
  CIITA targeting sequence
cagggcagcugacaaucaga

SEQ ID NO: 50902 - RNA, 20 nt, Artificial Sequence
  CIITA targeting sequence
gggcagcugacaaucagacu

SEQ ID NO: 50903 - RNA, 20 nt, Artificial Sequence
  CIITA targeting sequence
gcugcccugagaagcuuguu

SEQ ID NO: 50904 - RNA, 20 nt, Artificial Sequence
  CIITA targeting sequence
gacuuagcacagaugugccu

SEQ ID NO: 50905 - RNA, 20 nt, Artificial Sequence
  CIITA targeting sequence
gauugucagcugcccugaga

SEQ ID NO: 50906 - RNA, 20 nt, Artificial Sequence
  CIITA targeting sequence
gugcuaagucugauugucag

SEQ ID NO: 50907 - RNA, 20 nt, Artificial Sequence
  CIITA targeting sequence
guguugcucucagagaaaug

SEQ ID NO: 50908 - RNA, 20 nt, Artificial Sequence
  CIITA targeting sequence
cagagaaaugaacacaaggc

SEQ ID NO: 50909 - RNA, 20 nt, Artificial Sequence
  CIITA targeting sequence
gagaaaugaacacaaggcua

SEQ ID NO: 50910 - RNA, 20 nt, Artificial Sequence
  CIITA targeting sequence
gagagcaacacugaggcaca

SEQ ID NO: 50911 - RNA, 20 nt, Artificial Sequence
  CIITA targeting sequence
cugagagcaacacugaggca

SEQ ID NO: 50912 - RNA, 20 nt, Artificial Sequence
  CIITA targeting sequence
uuucucugagagcaacacug

SEQ ID NO: 50913 - RNA, 20 nt, Artificial Sequence
  CIITA targeting sequence
agccuuguguucauuucucu

SEQ ID NO: 50914 - RNA, 20 nt, Artificial Sequence
  CIITA targeting sequence
caccuguaauccuagcacuu

SEQ ID NO: 50915 - RNA, 20 nt, Artificial Sequence
  CIITA targeting sequence
uagcacuuugggaggccgag

SEQ ID NO: 50916 - RNA, 20 nt, Artificial Sequence
  CIITA targeting sequence
caaagugcuaggauuacagg

SEQ ID NO: 50917 - RNA, 20 nt, Artificial Sequence
  CIITA targeting sequence
gccucccaaagugcuaggau

SEQ ID NO: 50918 - RNA, 20 nt, Artificial Sequence
  CIITA targeting sequence
gcccaccucggccucccaaa

SEQ ID NO: 50919 - RNA, 20 nt, Artificial Sequence
  CIITA targeting sequence
uuugaggucaggaguucgag

SEQ ID NO: 50920 - RNA, 20 nt, Artificial Sequence
  CIITA targeting sequence
aaugauccgcccaccucggc

SEQ ID NO: 50921 - RNA, 20 nt, Artificial Sequence
  CIITA targeting sequence
ggaguucgagaccagccugg

SEQ ID NO: 50922 - RNA, 20 nt, Artificial Sequence
  CIITA targeting sequence
ugaccucaaaugauccgccc

SEQ ID NO: 50923 - RNA, 20 nt, Artificial Sequence
  CIITA targeting sequence
agaccagccuggccaacaug

SEQ ID NO: 50924 - RNA, 20 nt, Artificial Sequence
  CIITA targeting sequence
aacuccugaccucaaaugau

SEQ ID NO: 50925 - RNA, 20 nt, Artificial Sequence
  CIITA targeting sequence
cgaacuccugaccucaaaug

SEQ ID NO: 50926 - RNA, 20 nt, Artificial Sequence
  CIITA targeting sequence
ccauguuggccaggcugguc

SEQ ID NO: 50927 - RNA, 20 nt, Artificial Sequence
  CIITA targeting sequence
cgucucuacuaaaaacacaa

SEQ ID NO: 50928 - RNA, 20 nt, Artificial Sequence
  CIITA targeting sequence
cuacuaaaaacacaaaaauu

SEQ ID NO: 50929 - RNA, 20 nt, Artificial Sequence
  CIITA targeting sequence
acuaaaaacacaaaaauuag

SEQ ID NO: 50930 - RNA, 20 nt, Artificial Sequence
  CIITA targeting sequence
cagcuacucaggagguugag

SEQ ID NO: 50931 - RNA, 20 nt, Artificial Sequence
  CIITA targeting sequence
ggagguugaggcacaagaau

SEQ ID NO: 50932 - RNA, 20 nt, Artificial Sequence
  CIITA targeting sequence
ugaguagcugugauuacagg

SEQ ID NO: 50933 - RNA, 20 nt, Artificial Sequence
  CIITA targeting sequence
accuccugaguagcugugau

SEQ ID NO: 50934 - RNA, 20 nt, Artificial Sequence
  CIITA targeting sequence
ugugccucaaccuccugagu

SEQ ID NO: 50935 - RNA, 20 nt, Artificial Sequence
  CIITA targeting sequence
cuugaacccaggaggcagag

SEQ ID NO: 50936 - RNA, 20 nt, Artificial Sequence
  CIITA targeting sequence
agugauucuugugccucaac

SEQ ID NO: 50937 - RNA, 20 nt, Artificial Sequence
  CIITA targeting sequence
uggguucaagugauucuugu

SEQ ID NO: 50938 - RNA, 20 nt, Artificial Sequence
  CIITA targeting sequence
gccuccuggguucaagugau

SEQ ID NO: 50939 - RNA, 20 nt, Artificial Sequence
  CIITA targeting sequence
cugcaaccucugccuccugg

SEQ ID NO: 50940 - RNA, 20 nt, Artificial Sequence
  CIITA targeting sequence
gcucacugcaaccucugccu

SEQ ID NO: 50941 - RNA, 20 nt, Artificial Sequence
  CIITA targeting sequence
cagcucacugcaaccucugc

SEQ ID NO: 50942 - RNA, 20 nt, Artificial Sequence
  CIITA targeting sequence
cucucagcucacugcaaccu

SEQ ID NO: 50943 - RNA, 20 nt, Artificial Sequence
  CIITA targeting sequence
agccuggacaauagagcgag

SEQ ID NO: 50944 - RNA, 20 nt, Artificial Sequence
  CIITA targeting sequence
aggcuggagugcagugguuc

SEQ ID NO: 50945 - RNA, 20 nt, Artificial Sequence
  CIITA targeting sequence
auuguccaggcuggagugca

SEQ ID NO: 50946 - RNA, 20 nt, Artificial Sequence
  CIITA targeting sequence
cucuauuguccaggcuggag

SEQ ID NO: 50947 - RNA, 20 nt, Artificial Sequence
  CIITA targeting sequence
cgcucuauuguccaggcugg

SEQ ID NO: 50948 - RNA, 20 nt, Artificial Sequence
  CIITA targeting sequence
aucuaaaaaaaaaaaaaaag

SEQ ID NO: 50949 - RNA, 20 nt, Artificial Sequence
  CIITA targeting sequence
aaaaaaaaaaaaaaagaaaa

SEQ ID NO: 50950 - RNA, 20 nt, Artificial Sequence
  CIITA targeting sequence
uuuuuuuuuuuuuuagaugg

SEQ ID NO: 50951 - RNA, 20 nt, Artificial Sequence
  CIITA targeting sequence
uuucuuuuuuuuuuuuuuua

SEQ ID NO: 50952 - RNA, 20 nt, Artificial Sequence
  CIITA targeting sequence
uuucuuuucuuuuuuuuuuu

SEQ ID NO: 50953 - RNA, 20 nt, Artificial Sequence
  CIITA targeting sequence
uuucuuuucuuuucuuuuuu

SEQ ID NO: 50954 - RNA, 20 nt, Artificial Sequence
  CIITA targeting sequence
uucuuuucuuuucuuuucuu

SEQ ID NO: 50955 - RNA, 20 nt, Artificial Sequence
  CIITA targeting sequence
uuucuuucuuuucuuuucuu

SEQ ID NO: 50956 - RNA, 20 nt, Artificial Sequence
  CIITA targeting sequence
auuucuuuucuuucuuuucu

SEQ ID NO: 50957 - RNA, 20 nt, Artificial Sequence
  CIITA targeting sequence
cccaccccauucauccugcc

SEQ ID NO: 50958 - RNA, 20 nt, Artificial Sequence
  CIITA targeting sequence
caccccauucauccugccca

SEQ ID NO: 50959 - RNA, 20 nt, Artificial Sequence
  CIITA targeting sequence
uccugcccaccagacagggg

SEQ ID NO: 50960 - RNA, 20 nt, Artificial Sequence
  CIITA targeting sequence
ugcccaccagacaggggccu

SEQ ID NO: 50961 - RNA, 20 nt, Artificial Sequence
  CIITA targeting sequence
ggugggcaggaugaaugggg

SEQ ID NO: 50962 - RNA, 20 nt, Artificial Sequence
  CIITA targeting sequence
cuggauccaggcggauaguu

SEQ ID NO: 50963 - RNA, 20 nt, Artificial Sequence
  CIITA targeting sequence
ggauccaggcggauaguuuc

SEQ ID NO: 50964 - RNA, 20 nt, Artificial Sequence
  CIITA targeting sequence
agagaggccccugucuggug

SEQ ID NO: 50965 - RNA, 20 nt, Artificial Sequence
  CIITA targeting sequence
aggcggauaguuucuguuuc

SEQ ID NO: 50966 - RNA, 20 nt, Artificial Sequence
  CIITA targeting sequence
gccuggauccagagaggccc

SEQ ID NO: 50967 - RNA, 20 nt, Artificial Sequence
  CIITA targeting sequence
guuucuggcugacuaggccc

SEQ ID NO: 50968 - RNA, 20 nt, Artificial Sequence
  CIITA targeting sequence
ggcugacuaggcccuagaaa

SEQ ID NO: 50969 - RNA, 20 nt, Artificial Sequence
  CIITA targeting sequence
gccagaaacagaaacuaucc

SEQ ID NO: 50970 - RNA, 20 nt, Artificial Sequence
  CIITA targeting sequence
agggccuagucagccagaaa

SEQ ID NO: 50971 - RNA, 20 nt, Artificial Sequence
  CIITA targeting sequence
agagaaggggcuaaaaccuc

SEQ ID NO: 50972 - RNA, 20 nt, Artificial Sequence
  CIITA targeting sequence
ggauuucuagggccuaguca

SEQ ID NO: 50973 - RNA, 20 nt, Artificial Sequence
  CIITA targeting sequence
cuggauuucuagggccuagu

SEQ ID NO: 50974 - RNA, 20 nt, Artificial Sequence
  CIITA targeting sequence
cuuugguggagguggggugg

SEQ ID NO: 50975 - RNA, 20 nt, Artificial Sequence
  CIITA targeting sequence
accaaagugagguuuuagcc

SEQ ID NO: 50976 - RNA, 20 nt, Artificial Sequence
  CIITA targeting sequence
gccaccccaccuccaccaaa

SEQ ID NO: 50977 - RNA, 20 nt, Artificial Sequence
  CIITA targeting sequence
cagccaccccaccuccacca

SEQ ID NO: 50978 - RNA, 20 nt, Artificial Sequence
  CIITA targeting sequence
aauucuuggguaccaccauc

SEQ ID NO: 50979 - RNA, 20 nt, Artificial Sequence
  CIITA targeting sequence
uggguaccaccaucucggug

SEQ ID NO: 50980 - RNA, 20 nt, Artificial Sequence
  CIITA targeting sequence
cggugaugacucugggauaa

SEQ ID NO: 50981 - RNA, 20 nt, Artificial Sequence
  CIITA targeting sequence
gugaugacucugggauaagu

SEQ ID NO: 50982 - RNA, 20 nt, Artificial Sequence
  CIITA targeting sequence
ccgagauggugguacccaag

SEQ ID NO: 50983 - RNA, 20 nt, Artificial Sequence
  CIITA targeting sequence
ucaccgagauggugguaccc

SEQ ID NO: 50984 - RNA, 20 nt, Artificial Sequence
  CIITA targeting sequence
gggauaagucacuuccucag

SEQ ID NO: 50985 - RNA, 20 nt, Artificial Sequence
  CIITA targeting sequence
cagagucaucaccgagaugg

SEQ ID NO: 50986 - RNA, 20 nt, Artificial Sequence
  CIITA targeting sequence
cuuccucaguuccccaguuc

SEQ ID NO: 50987 - RNA, 20 nt, Artificial Sequence
  CIITA targeting sequence
ucaguuccccaguucacaga

SEQ ID NO: 50988 - RNA, 20 nt, Artificial Sequence
  CIITA targeting sequence
guuccccaguucacagaaac

SEQ ID NO: 50989 - RNA, 20 nt, Artificial Sequence
  CIITA targeting sequence
ccaguucacagaaaccccag

SEQ ID NO: 50990 - RNA, 20 nt, Artificial Sequence
  CIITA targeting sequence
cagaaaccccaguuguaaau

SEQ ID NO: 50991 - RNA, 20 nt, Artificial Sequence
  CIITA targeting sequence
gugaacuggggaacugagga

SEQ ID NO: 50992 - RNA, 20 nt, Artificial Sequence
  CIITA targeting sequence
auauuuacaacugggguuuc

SEQ ID NO: 50993 - RNA, 20 nt, Artificial Sequence
  CIITA targeting sequence
gccccugggcccaccacccc

SEQ ID NO: 50994 - RNA, 20 nt, Artificial Sequence
  CIITA targeting sequence
cucugccccugggcccacca

SEQ ID NO: 50995 - RNA, 20 nt, Artificial Sequence
  CIITA targeting sequence
cacucugccccugggcccac

SEQ ID NO: 50996 - RNA, 20 nt, Artificial Sequence
  CIITA targeting sequence
ccaucucacucugccccugg

SEQ ID NO: 50997 - RNA, 20 nt, Artificial Sequence
  CIITA targeting sequence
cuccccaucucacucugccc

SEQ ID NO: 50998 - RNA, 20 nt, Artificial Sequence
  CIITA targeting sequence
ucacuccccaucucacucug

SEQ ID NO: 50999 - RNA, 20 nt, Artificial Sequence
  CIITA targeting sequence
uccucacuccccaucucacu

SEQ ID NO: 51000 - RNA, 20 nt, Artificial Sequence
  CIITA targeting sequence
uccuccucacuccccaucuc

SEQ ID NO: 51001 - RNA, 20 nt, Artificial Sequence
  CIITA targeting sequence
uugguucuuccuccucacuc

SEQ ID NO: 51002 - RNA, 20 nt, Artificial Sequence
  CIITA targeting sequence
gauuccucugaaaaggcaga

SEQ ID NO: 51003 - RNA, 20 nt, Artificial Sequence
  CIITA targeting sequence
gauuuuguccuugguucuuc

SEQ ID NO: 51004 - RNA, 20 nt, Artificial Sequence
  CIITA targeting sequence
ucugaaaaggcagaagccuc

SEQ ID NO: 51005 - RNA, 20 nt, Artificial Sequence
  CIITA targeting sequence
gaaaaggcagaagccuccag

SEQ ID NO: 51006 - RNA, 20 nt, Artificial Sequence
  CIITA targeting sequence
gaggaaucagauuuuguccu

SEQ ID NO: 51007 - RNA, 20 nt, Artificial Sequence
  CIITA targeting sequence
gccuuuucagaggaaucaga

SEQ ID NO: 51008 - RNA, 20 nt, Artificial Sequence
  CIITA targeting sequence
aggccaaugggguuuucuua

SEQ ID NO: 51009 - RNA, 20 nt, Artificial Sequence
  CIITA targeting sequence
uaaccugcuuuugggaagga

SEQ ID NO: 51010 - RNA, 20 nt, Artificial Sequence
  CIITA targeting sequence
caaaagcagguuaagaaaac

SEQ ID NO: 51011 - RNA, 20 nt, Artificial Sequence
  CIITA targeting sequence
uucccaaaagcagguuaaga

SEQ ID NO: 51012 - RNA, 20 nt, Artificial Sequence
  CIITA targeting sequence
uuccuucccaaaagcagguu

SEQ ID NO: 51013 - RNA, 20 nt, Artificial Sequence
  CIITA targeting sequence
ggcuuuuggucucucugggc

SEQ ID NO: 51014 - RNA, 20 nt, Artificial Sequence
  CIITA targeting sequence
cucugggccucaguuuccuc

SEQ ID NO: 51015 - RNA, 20 nt, Artificial Sequence
  CIITA targeting sequence
cugggccucaguuuccuccu

SEQ ID NO: 51016 - RNA, 20 nt, Artificial Sequence
  CIITA targeting sequence
gggccucaguuuccuccucu

SEQ ID NO: 51017 - RNA, 20 nt, Artificial Sequence
  CIITA targeting sequence
guuuccuccucuauaaaaug

SEQ ID NO: 51018 - RNA, 20 nt, Artificial Sequence
  CIITA targeting sequence
uccucuauaaaaugaaaaug

SEQ ID NO: 51019 - RNA, 20 nt, Artificial Sequence
  CIITA targeting sequence
ucuauaaaaugaaaaugaua

SEQ ID NO: 51020 - RNA, 20 nt, Artificial Sequence
  CIITA targeting sequence
auaaaaugaaaaugauauua

SEQ ID NO: 51021 - RNA, 20 nt, Artificial Sequence
  CIITA targeting sequence
uuuuauagaggaggaaacug

SEQ ID NO: 51022 - RNA, 20 nt, Artificial Sequence
  CIITA targeting sequence
uuuucauuuuauagaggagg

SEQ ID NO: 51023 - RNA, 20 nt, Artificial Sequence
  CIITA targeting sequence
agcuaauaucauuuucauuu

SEQ ID NO: 51024 - RNA, 20 nt, Artificial Sequence
  CIITA targeting sequence
uauggcucaagcuaauauca

SEQ ID NO: 51025 - RNA, 20 nt, Artificial Sequence
  CIITA targeting sequence
ugugguuucgaccuccaaaa

SEQ ID NO: 51026 - RNA, 20 nt, Artificial Sequence
  CIITA targeting sequence
accuccaaaaccagcaauuu

SEQ ID NO: 51027 - RNA, 20 nt, Artificial Sequence
  CIITA targeting sequence
aaaccacaagaguguuggca

SEQ ID NO: 51028 - RNA, 20 nt, Artificial Sequence
  CIITA targeting sequence
aaaaccagcaauuucauaug

SEQ ID NO: 51029 - RNA, 20 nt, Artificial Sequence
  CIITA targeting sequence
uaugaugcucuaacaugacu

SEQ ID NO: 51030 - RNA, 20 nt, Artificial Sequence
  CIITA targeting sequence
uaugaaauugcugguuuugg

SEQ ID NO: 51031 - RNA, 20 nt, Artificial Sequence
  CIITA targeting sequence
aacaugacuuaucuggaaaa

SEQ ID NO: 51032 - RNA, 20 nt, Artificial Sequence
  CIITA targeting sequence
uguuagagcaucauaugaaa

SEQ ID NO: 51033 - RNA, 20 nt, Artificial Sequence
  CIITA targeting sequence
ggaaaacugcagacugaaau

SEQ ID NO: 51034 - RNA, 20 nt, Artificial Sequence
  CIITA targeting sequence
agauaagucauguuagagca

SEQ ID NO: 51035 - RNA, 20 nt, Artificial Sequence
  CIITA targeting sequence
gcaguuuuccagauaaguca

SEQ ID NO: 51036 - RNA, 20 nt, Artificial Sequence
  CIITA targeting sequence
gucugcaguuuuccagauaa

SEQ ID NO: 51037 - RNA, 20 nt, Artificial Sequence
  CIITA targeting sequence
uuucagucugcaguuuucca

SEQ ID NO: 51038 - RNA, 20 nt, Artificial Sequence
  CIITA targeting sequence
cauuucagucugcaguuuuc

SEQ ID NO: 51039 - RNA, 20 nt, Artificial Sequence
  CIITA targeting sequence
ugcaaagugcuuagcagagu

SEQ ID NO: 51040 - RNA, 20 nt, Artificial Sequence
  CIITA targeting sequence
gcuaagcacuuugcaggauc

SEQ ID NO: 51041 - RNA, 20 nt, Artificial Sequence
  CIITA targeting sequence
cucugcuaagcacuuugcag

SEQ ID NO: 51042 - RNA, 20 nt, Artificial Sequence
  CIITA targeting sequence
auaaacaauaggccuuaugu

SEQ ID NO: 51043 - RNA, 20 nt, Artificial Sequence
  CIITA targeting sequence
aauaaaaauauuauuuuuuu

SEQ ID NO: 51044 - RNA, 20 nt, Artificial Sequence
  CIITA targeting sequence
acaaaaaaauaauauuuuua

SEQ ID NO: 51045 - RNA, 20 nt, Artificial Sequence
  CIITA targeting sequence
cuacaaaaaaauaauauuuu

SEQ ID NO: 51046 - RNA, 20 nt, Artificial Sequence
  CIITA targeting sequence
cacuagguugccuaggcugg

SEQ ID NO: 51047 - RNA, 20 nt, Artificial Sequence
  CIITA targeting sequence
cuagguugccuaggcugguc

SEQ ID NO: 51048 - RNA, 20 nt, Artificial Sequence
  CIITA targeting sequence
ugaacucccgggcucaagcg

SEQ ID NO: 51049 - RNA, 20 nt, Artificial Sequence
  CIITA targeting sequence
agaccagccuaggcaaccua

SEQ ID NO: 51050 - RNA, 20 nt, Artificial Sequence
  CIITA targeting sequence
cgggcucaagcgauccuccu

SEQ ID NO: 51051 - RNA, 20 nt, Artificial Sequence
  CIITA targeting sequence
agcgauccuccugccuuggc

SEQ ID NO: 51052 - RNA, 20 nt, Artificial Sequence
  CIITA targeting sequence
cuugagcccgggaguucaag

SEQ ID NO: 51053 - RNA, 20 nt, Artificial Sequence
  CIITA targeting sequence
uccugccuuggccucccaaa

SEQ ID NO: 51054 - RNA, 20 nt, Artificial Sequence
  CIITA targeting sequence
ugccuuggccucccaaagug

SEQ ID NO: 51055 - RNA, 20 nt, Artificial Sequence
  CIITA targeting sequence
caaagugggauuacaggugu

SEQ ID NO: 51056 - RNA, 20 nt, Artificial Sequence
  CIITA targeting sequence
cacuuugggaggccaaggca

SEQ ID NO: 51057 - RNA, 20 nt, Artificial Sequence
  CIITA targeting sequence
caccuguaaucccacuuugg

SEQ ID NO: 51058 - RNA, 20 nt, Artificial Sequence
  CIITA targeting sequence
uauaucucuuauaucuccua

SEQ ID NO: 51059 - RNA, 20 nt, Artificial Sequence
  CIITA targeting sequence
cuuauaucuccuaucuaaug

SEQ ID NO: 51060 - RNA, 20 nt, Artificial Sequence
  CIITA targeting sequence
uauaucuccuaucuaaugau

SEQ ID NO: 51061 - RNA, 20 nt, Artificial Sequence
  CIITA targeting sequence
ccuaucuaaugauaugucac

SEQ ID NO: 51062 - RNA, 20 nt, Artificial Sequence
  CIITA targeting sequence
uaucuaaugauaugucacca

SEQ ID NO: 51063 - RNA, 20 nt, Artificial Sequence
  CIITA targeting sequence
aaugauaugucaccaguaau

SEQ ID NO: 51064 - RNA, 20 nt, Artificial Sequence
  CIITA targeting sequence
uuagauaggagauauaagag

SEQ ID NO: 51065 - RNA, 20 nt, Artificial Sequence
  CIITA targeting sequence
ccaguaauaauaauggcagu

SEQ ID NO: 51066 - RNA, 20 nt, Artificial Sequence
  CIITA targeting sequence
uaauucuuucacccauccuc

SEQ ID NO: 51067 - RNA, 20 nt, Artificial Sequence
  CIITA targeting sequence
uucacccauccucuccuugu

SEQ ID NO: 51068 - RNA, 20 nt, Artificial Sequence
  CIITA targeting sequence
cccauccucuccuugucaaa

SEQ ID NO: 51069 - RNA, 20 nt, Artificial Sequence
  CIITA targeting sequence
ucuccuugucaaacccacag

SEQ ID NO: 51070 - RNA, 20 nt, Artificial Sequence
  CIITA targeting sequence
ccuugucaaacccacagcca

SEQ ID NO: 51071 - RNA, 20 nt, Artificial Sequence
  CIITA targeting sequence
uugucaaacccacagccacu

SEQ ID NO: 51072 - RNA, 20 nt, Artificial Sequence
  CIITA targeting sequence
aacccacagccacuuccacu

SEQ ID NO: 51073 - RNA, 20 nt, Artificial Sequence
  CIITA targeting sequence
acuuacugagcacacugugc

SEQ ID NO: 51074 - RNA, 20 nt, Artificial Sequence
  CIITA targeting sequence
guaaguggaaguggcugugg

SEQ ID NO: 51075 - RNA, 20 nt, Artificial Sequence
  CIITA targeting sequence
ugggugcacagugugcucag

SEQ ID NO: 51076 - RNA, 20 nt, Artificial Sequence
  CIITA targeting sequence
guccugggugcacagugugc

SEQ ID NO: 51077 - RNA, 20 nt, Artificial Sequence
  CIITA targeting sequence
ccauucgguuuucaccacuu

SEQ ID NO: 51078 - RNA, 20 nt, Artificial Sequence
  CIITA targeting sequence
auucgguuuucaccacuuac

SEQ ID NO: 51079 - RNA, 20 nt, Artificial Sequence
  CIITA targeting sequence
guuuucaccacuuacuguca

SEQ ID NO: 51080 - RNA, 20 nt, Artificial Sequence
  CIITA targeting sequence
ccacuuacugucacccacaa

SEQ ID NO: 51081 - RNA, 20 nt, Artificial Sequence
  CIITA targeting sequence
cccacaagcgugagccugug

SEQ ID NO: 51082 - RNA, 20 nt, Artificial Sequence
  CIITA targeting sequence
cgcuugugggugacaguaag

SEQ ID NO: 51083 - RNA, 20 nt, Artificial Sequence
  CIITA targeting sequence
gagcucaggauucaugugua

SEQ ID NO: 51084 - RNA, 20 nt, Artificial Sequence
  CIITA targeting sequence
gacaccaugccugcacaggc

SEQ ID NO: 51085 - RNA, 20 nt, Artificial Sequence
  CIITA targeting sequence
ggauucauguguacacagca

SEQ ID NO: 51086 - RNA, 20 nt, Artificial Sequence
  CIITA targeting sequence
ugagcucugacaccaugccu

SEQ ID NO: 51087 - RNA, 20 nt, Artificial Sequence
  CIITA targeting sequence
uguguacacagcauauaagc

SEQ ID NO: 51088 - RNA, 20 nt, Artificial Sequence
  CIITA targeting sequence
ugcuggcuuauaugcugugu

SEQ ID NO: 51089 - RNA, 20 nt, Artificial Sequence
  CIITA targeting sequence
cauucugugucccuucucau

SEQ ID NO: 51090 - RNA, 20 nt, Artificial Sequence
  CIITA targeting sequence
uucugugucccuucucauuc

SEQ ID NO: 51091 - RNA, 20 nt, Artificial Sequence
  CIITA targeting sequence
gugucccuucucauucuggc

SEQ ID NO: 51092 - RNA, 20 nt, Artificial Sequence
  CIITA targeting sequence
cuucucauucuggccaucuc

SEQ ID NO: 51093 - RNA, 20 nt, Artificial Sequence
  CIITA targeting sequence
cauucuggccaucucacucc

SEQ ID NO: 51094 - RNA, 20 nt, Artificial Sequence
  CIITA targeting sequence
uucuggccaucucacuccag

SEQ ID NO: 51095 - RNA, 20 nt, Artificial Sequence
  CIITA targeting sequence
ggccaucucacuccagagug

SEQ ID NO: 51096 - RNA, 20 nt, Artificial Sequence
  CIITA targeting sequence
cacuccagagugagaaccag

SEQ ID NO: 51097 - RNA, 20 nt, Artificial Sequence
  CIITA targeting sequence
cuccagagugagaaccaguc

SEQ ID NO: 51098 - RNA, 20 nt, Artificial Sequence
  CIITA targeting sequence
agagugagaaccagucucuc

SEQ ID NO: 51099 - RNA, 20 nt, Artificial Sequence
  CIITA targeting sequence
ggagugagauggccagaaug

SEQ ID NO: 51100 - RNA, 20 nt, Artificial Sequence
  CIITA targeting sequence
cucuggagugagauggccag

SEQ ID NO: 51101 - RNA, 20 nt, Artificial Sequence
  CIITA targeting sequence
cacucuggagugagauggcc

SEQ ID NO: 51102 - RNA, 20 nt, Artificial Sequence
  CIITA targeting sequence
cuccucauuuggcgcaugcu

SEQ ID NO: 51103 - RNA, 20 nt, Artificial Sequence
  CIITA targeting sequence
ccucauuuggcgcaugcuug

SEQ ID NO: 51104 - RNA, 20 nt, Artificial Sequence
  CIITA targeting sequence
ucauuuggcgcaugcuugcu

SEQ ID NO: 51105 - RNA, 20 nt, Artificial Sequence
  CIITA targeting sequence
uuuggcgcaugcuugcugag

SEQ ID NO: 51106 - RNA, 20 nt, Artificial Sequence
  CIITA targeting sequence
gcaagcaugcgccaaaugag

SEQ ID NO: 51107 - RNA, 20 nt, Artificial Sequence
  CIITA targeting sequence
ucagcaagcaugcgccaaau

SEQ ID NO: 51108 - RNA, 20 nt, Artificial Sequence
  CIITA targeting sequence
ugguuaaucuugaguuuaua

SEQ ID NO: 51109 - RNA, 20 nt, Artificial Sequence
  CIITA targeting sequence
ugaguuuauauccuacuaua

SEQ ID NO: 51110 - RNA, 20 nt, Artificial Sequence
  CIITA targeting sequence
agauuaaccaugagcguggu

SEQ ID NO: 51111 - RNA, 20 nt, Artificial Sequence
  CIITA targeting sequence
uacuauaguguuaagaucaa

SEQ ID NO: 51112 - RNA, 20 nt, Artificial Sequence
  CIITA targeting sequence
uaacacuauaguaggauaua

SEQ ID NO: 51113 - RNA, 20 nt, Artificial Sequence
  CIITA targeting sequence
aaagucauccuuggccaggc

SEQ ID NO: 51114 - RNA, 20 nt, Artificial Sequence
  CIITA targeting sequence
uccuuggccaggcgugguga

SEQ ID NO: 51115 - RNA, 20 nt, Artificial Sequence
  CIITA targeting sequence
uuggccaggcguggugacuc

SEQ ID NO: 51116 - RNA, 20 nt, Artificial Sequence
  CIITA targeting sequence
ccacgccuggccaaggauga

SEQ ID NO: 51117 - RNA, 20 nt, Artificial Sequence
  CIITA targeting sequence
agccuguaauccuagcacuu

SEQ ID NO: 51118 - RNA, 20 nt, Artificial Sequence
  CIITA targeting sequence
uagcacuuugggaggccgag

SEQ ID NO: 51119 - RNA, 20 nt, Artificial Sequence
  CIITA targeting sequence
caaagugcuaggauuacagg

SEQ ID NO: 51120 - RNA, 20 nt, Artificial Sequence
  CIITA targeting sequence
gccucccaaagugcuaggau

SEQ ID NO: 51121 - RNA, 20 nt, Artificial Sequence
  CIITA targeting sequence
cuuguggucaggaguucaag

SEQ ID NO: 51122 - RNA, 20 nt, Artificial Sequence
  CIITA targeting sequence
ggaguucaagaccagccuga

SEQ ID NO: 51123 - RNA, 20 nt, Artificial Sequence
  CIITA targeting sequence
ugaccacaagugaccugccc

SEQ ID NO: 51124 - RNA, 20 nt, Artificial Sequence
  CIITA targeting sequence
agaccagccugaccaacaug

SEQ ID NO: 51125 - RNA, 20 nt, Artificial Sequence
  CIITA targeting sequence
ugaacuccugaccacaagug

SEQ ID NO: 51126 - RNA, 20 nt, Artificial Sequence
  CIITA targeting sequence
ggcuggucuugaacuccuga

SEQ ID NO: 51127 - RNA, 20 nt, Artificial Sequence
  CIITA targeting sequence
ccauguuggucaggcugguc

SEQ ID NO: 51128 - RNA, 20 nt, Artificial Sequence
  CIITA targeting sequence
cuacuaaaaacacaaaaaau

SEQ ID NO: 51129 - RNA, 20 nt, Artificial Sequence
  CIITA targeting sequence
acuaaaaacacaaaaaauua

SEQ ID NO: 51130 - RNA, 20 nt, Artificial Sequence
  CIITA targeting sequence
caguuacacauugaggcacg

SEQ ID NO: 51131 - RNA, 20 nt, Artificial Sequence
  CIITA targeting sequence
guagauguuuguuguucauc

SEQ ID NO: 51132 - RNA, 20 nt, Artificial Sequence
  CIITA targeting sequence
accgacugcuuauuagacac

SEQ ID NO: 51133 - RNA, 20 nt, Artificial Sequence
  CIITA targeting sequence
ucugagggugccugugggug

SEQ ID NO: 51134 - RNA, 20 nt, Artificial Sequence
  CIITA targeting sequence
gagggugccugugggugugg

SEQ ID NO: 51135 - RNA, 20 nt, Artificial Sequence
  CIITA targeting sequence
gaugaacaacaaacaucuac

SEQ ID NO: 51136 - RNA, 20 nt, Artificial Sequence
  CIITA targeting sequence
aacacacugccacacccaca

SEQ ID NO: 51137 - RNA, 20 nt, Artificial Sequence
  CIITA targeting sequence
gugggcuccaacacacugcc

SEQ ID NO: 51138 - RNA, 20 nt, Artificial Sequence
  CIITA targeting sequence
accccuguguccauuuuuuu

SEQ ID NO: 51139 - RNA, 20 nt, Artificial Sequence
  CIITA targeting sequence
auuuuuuuaaagagauggag

SEQ ID NO: 51140 - RNA, 20 nt, Artificial Sequence
  CIITA targeting sequence
uuaaaaaaauggacacaggg

SEQ ID NO: 51141 - RNA, 20 nt, Artificial Sequence
  CIITA targeting sequence
cuuuaaaaaaauggacacag

SEQ ID NO: 51142 - RNA, 20 nt, Artificial Sequence
  CIITA targeting sequence
aucucuuuaaaaaaauggac

SEQ ID NO: 51143 - RNA, 20 nt, Artificial Sequence
  CIITA targeting sequence
guugcucaggcuggagugua

SEQ ID NO: 51144 - RNA, 20 nt, Artificial Sequence
  CIITA targeting sequence
ggcuggaguguagugauagg

SEQ ID NO: 51145 - RNA, 20 nt, Artificial Sequence
  CIITA targeting sequence
agccugagcaacagagcuac

SEQ ID NO: 51146 - RNA, 20 nt, Artificial Sequence
  CIITA targeting sequence
cuacacuccagccugagcaa

SEQ ID NO: 51147 - RNA, 20 nt, Artificial Sequence
  CIITA targeting sequence
uaucacuacacuccagccug

SEQ ID NO: 51148 - RNA, 20 nt, Artificial Sequence
  CIITA targeting sequence
aggaggcacuauagccucga

SEQ ID NO: 51149 - RNA, 20 nt, Artificial Sequence
  CIITA targeting sequence
auccuaucacuacacuccag

SEQ ID NO: 51150 - RNA, 20 nt, Artificial Sequence
  CIITA targeting sequence
ucgauccuaucacuacacuc

SEQ ID NO: 51151 - RNA, 20 nt, Artificial Sequence
  CIITA targeting sequence
accuccugggcucaagagau

SEQ ID NO: 51152 - RNA, 20 nt, Artificial Sequence
  CIITA targeting sequence
aggcuauagugccuccucga

SEQ ID NO: 51153 - RNA, 20 nt, Artificial Sequence
  CIITA targeting sequence
ugggcucaagagauucuccc

SEQ ID NO: 51154 - RNA, 20 nt, Artificial Sequence
  CIITA targeting sequence
agagauucucccaucucagc

SEQ ID NO: 51155 - RNA, 20 nt, Artificial Sequence
  CIITA targeting sequence
ugagcccaggaggucgaggc

SEQ ID NO: 51156 - RNA, 20 nt, Artificial Sequence
  CIITA targeting sequence
cuugagcccaggaggucgag

SEQ ID NO: 51157 - RNA, 20 nt, Artificial Sequence
  CIITA targeting sequence
cccaucucagccuccugagu

SEQ ID NO: 51158 - RNA, 20 nt, Artificial Sequence
  CIITA targeting sequence
caucucagccuccugaguag

SEQ ID NO: 51159 - RNA, 20 nt, Artificial Sequence
  CIITA targeting sequence
cagccuccugaguagcugag

SEQ ID NO: 51160 - RNA, 20 nt, Artificial Sequence
  CIITA targeting sequence
gccuccugaguagcugagac

SEQ ID NO: 51161 - RNA, 20 nt, Artificial Sequence
  CIITA targeting sequence
ugaguagcugagacuacagg

SEQ ID NO: 51162 - RNA, 20 nt, Artificial Sequence
  CIITA targeting sequence
ggaggcugagaugggagaau

SEQ ID NO: 51163 - RNA, 20 nt, Artificial Sequence
  CIITA targeting sequence
gcuacucaggaggcugagau

SEQ ID NO: 51164 - RNA, 20 nt, Artificial Sequence
  CIITA targeting sequence
cagcuacucaggaggcugag

SEQ ID NO: 51165 - RNA, 20 nt, Artificial Sequence
  CIITA targeting sequence
cuacaaaaaauuuaaaaaau

SEQ ID NO: 51166 - RNA, 20 nt, Artificial Sequence
  CIITA targeting sequence
cacuacguugcccaggcugg

SEQ ID NO: 51167 - RNA, 20 nt, Artificial Sequence
  CIITA targeting sequence
cuacguugcccaggcugguc

SEQ ID NO: 51168 - RNA, 20 nt, Artificial Sequence
  CIITA targeting sequence
cgaacuccuguccuuuagug

SEQ ID NO: 51169 - RNA, 20 nt, Artificial Sequence
  CIITA targeting sequence
aacuccuguccuuuagugac

SEQ ID NO: 51170 - RNA, 20 nt, Artificial Sequence
  CIITA targeting sequence
agaccagccugggcaacgua

SEQ ID NO: 51171 - RNA, 20 nt, Artificial Sequence
  CIITA targeting sequence
uguccuuuagugacccuccu

SEQ ID NO: 51172 - RNA, 20 nt, Artificial Sequence
  CIITA targeting sequence
uuuagugacccuccugcccu

SEQ ID NO: 51173 - RNA, 20 nt, Artificial Sequence
  CIITA targeting sequence
cuaaaggacaggaguucgag

SEQ ID NO: 51174 - RNA, 20 nt, Artificial Sequence
  CIITA targeting sequence
ugcccuggcuucccaaagca

SEQ ID NO: 51175 - RNA, 20 nt, Artificial Sequence
  CIITA targeting sequence
caaagcacugccuuauaucu

SEQ ID NO: 51176 - RNA, 20 nt, Artificial Sequence
  CIITA targeting sequence
auguuugaagcccuagucca

SEQ ID NO: 51177 - RNA, 20 nt, Artificial Sequence
  CIITA targeting sequence
aacauagauauaaggcagug

SEQ ID NO: 51178 - RNA, 20 nt, Artificial Sequence
  CIITA targeting sequence
agggaccacaggccagggaa

SEQ ID NO: 51179 - RNA, 20 nt, Artificial Sequence
  CIITA targeting sequence
cuggacuagggcuucaaaca

SEQ ID NO: 51180 - RNA, 20 nt, Artificial Sequence
  CIITA targeting sequence
cuggccuguggucccuggac

SEQ ID NO: 51181 - RNA, 20 nt, Artificial Sequence
  CIITA targeting sequence
cuugcugugccuucccuggc

SEQ ID NO: 51182 - RNA, 20 nt, Artificial Sequence
  CIITA targeting sequence
ugcucccuugcugugccuuc

SEQ ID NO: 51183 - RNA, 20 nt, Artificial Sequence
  CIITA targeting sequence
aaagguacacucagcacacg

SEQ ID NO: 51184 - RNA, 20 nt, Artificial Sequence
  CIITA targeting sequence
gcacacguggguucuccuca

SEQ ID NO: 51185 - RNA, 20 nt, Artificial Sequence
  CIITA targeting sequence
ccucacugccaccagugaca

SEQ ID NO: 51186 - RNA, 20 nt, Artificial Sequence
  CIITA targeting sequence
ucacugccaccagugacaga

SEQ ID NO: 51187 - RNA, 20 nt, Artificial Sequence
  CIITA targeting sequence
cugccaccagugacagacag

SEQ ID NO: 51188 - RNA, 20 nt, Artificial Sequence
  CIITA targeting sequence
cugguggcagugaggagaac

SEQ ID NO: 51189 - RNA, 20 nt, Artificial Sequence
  CIITA targeting sequence
gucacugguggcagugagga

SEQ ID NO: 51190 - RNA, 20 nt, Artificial Sequence
  CIITA targeting sequence
uuuucugaaguccuguguuc

SEQ ID NO: 51191 - RNA, 20 nt, Artificial Sequence
  CIITA targeting sequence
gaaguccuguguucaaaaug

SEQ ID NO: 51192 - RNA, 20 nt, Artificial Sequence
  CIITA targeting sequence
gaaaaugaaaccaaagcugu

SEQ ID NO: 51193 - RNA, 20 nt, Artificial Sequence
  CIITA targeting sequence
uguguucaaaaugaaaccaa

SEQ ID NO: 51194 - RNA, 20 nt, Artificial Sequence
  CIITA targeting sequence
aaaugaaaccaaauccagau

SEQ ID NO: 51195 - RNA, 20 nt, Artificial Sequence
  CIITA targeting sequence
uuuugaacacaggacuucag

SEQ ID NO: 51196 - RNA, 20 nt, Artificial Sequence
  CIITA targeting sequence
agaugccgaaagagaaaagg

SEQ ID NO: 51197 - RNA, 20 nt, Artificial Sequence
  CIITA targeting sequence
ggauuugguuucauuuugaa

SEQ ID NO: 51198 - RNA, 20 nt, Artificial Sequence
  CIITA targeting sequence
gcaucuggauuugguuucau

SEQ ID NO: 51199 - RNA, 20 nt, Artificial Sequence
  CIITA targeting sequence
uucggcaucuggauuugguu

SEQ ID NO: 51200 - RNA, 20 nt, Artificial Sequence
  CIITA targeting sequence
cuuucggcaucuggauuugg

SEQ ID NO: 51201 - RNA, 20 nt, Artificial Sequence
  CIITA targeting sequence
uuuucucuuucggcaucugg

SEQ ID NO: 51202 - RNA, 20 nt, Artificial Sequence
  CIITA targeting sequence
gcugguugacaagcauccac

SEQ ID NO: 51203 - RNA, 20 nt, Artificial Sequence
  CIITA targeting sequence
accagcagauuuccuuuucu

SEQ ID NO: 51204 - RNA, 20 nt, Artificial Sequence
  CIITA targeting sequence
accuugugggcuguucugcu

SEQ ID NO: 51205 - RNA, 20 nt, Artificial Sequence
  CIITA targeting sequence
gcuggagggcugggcaccag

SEQ ID NO: 51206 - RNA, 20 nt, Artificial Sequence
  CIITA targeting sequence
agcagaacagcccacaaggu

SEQ ID NO: 51207 - RNA, 20 nt, Artificial Sequence
  CIITA targeting sequence
caggaagccaggcagugcga

SEQ ID NO: 51208 - RNA, 20 nt, Artificial Sequence
  CIITA targeting sequence
ugugagccuggugcccagcc

SEQ ID NO: 51209 - RNA, 20 nt, Artificial Sequence
  CIITA targeting sequence
cacugccuggcuuccuguga

SEQ ID NO: 51210 - RNA, 20 nt, Artificial Sequence
  CIITA targeting sequence
ggguuucgcacugccuggcu

SEQ ID NO: 51211 - RNA, 20 nt, Artificial Sequence
  CIITA targeting sequence
gagugcucgguaggauggga

SEQ ID NO: 51212 - RNA, 20 nt, Artificial Sequence
  CIITA targeting sequence
gagccccucaggguuucgca

SEQ ID NO: 51213 - RNA, 20 nt, Artificial Sequence
  CIITA targeting sequence
guaggaugggaccaggcucu

SEQ ID NO: 51214 - RNA, 20 nt, Artificial Sequence
  CIITA targeting sequence
uaccgagcacucugagcccc

SEQ ID NO: 51215 - RNA, 20 nt, Artificial Sequence
  CIITA targeting sequence
cauccuaccgagcacucuga

SEQ ID NO: 51216 - RNA, 20 nt, Artificial Sequence
  CIITA targeting sequence
gaccccagaccugcugcaug

SEQ ID NO: 51217 - RNA, 20 nt, Artificial Sequence
  CIITA targeting sequence
gagccuggucccauccuacc

SEQ ID NO: 51218 - RNA, 20 nt, Artificial Sequence
  CIITA targeting sequence
ggggucagagccugguccca

SEQ ID NO: 51219 - RNA, 20 nt, Artificial Sequence
  CIITA targeting sequence
ugcagcaggucuggggucag

SEQ ID NO: 51220 - RNA, 20 nt, Artificial Sequence
  CIITA targeting sequence
cuugcccaaggucaugcagc

SEQ ID NO: 51221 - RNA, 20 nt, Artificial Sequence
  CIITA targeting sequence
ucuugggaccugauuugccc

SEQ ID NO: 51222 - RNA, 20 nt, Artificial Sequence
  CIITA targeting sequence
ugggaccugauuugccccaa

SEQ ID NO: 51223 - RNA, 20 nt, Artificial Sequence
  CIITA targeting sequence
caagaggacaggucacuugc

SEQ ID NO: 51224 - RNA, 20 nt, Artificial Sequence
  CIITA targeting sequence
ggucccaagaggacagguca

SEQ ID NO: 51225 - RNA, 20 nt, Artificial Sequence
  CIITA targeting sequence
cuuugcaguuggggcaaauc

SEQ ID NO: 51226 - RNA, 20 nt, Artificial Sequence
  CIITA targeting sequence
cuggacaucucguaccucac

SEQ ID NO: 51227 - RNA, 20 nt, Artificial Sequence
  CIITA targeting sequence
ggacaucucguaccucacag

SEQ ID NO: 51228 - RNA, 20 nt, Artificial Sequence
  CIITA targeting sequence
agagaucacuuugcaguugg

SEQ ID NO: 51229 - RNA, 20 nt, Artificial Sequence
  CIITA targeting sequence
cguaccucacagagcagcca

SEQ ID NO: 51230 - RNA, 20 nt, Artificial Sequence
  CIITA targeting sequence
uaccucacagagcagccaga

SEQ ID NO: 51231 - RNA, 20 nt, Artificial Sequence
  CIITA targeting sequence
cagagcagccagacaugcag

SEQ ID NO: 51232 - RNA, 20 nt, Artificial Sequence
  CIITA targeting sequence
gugagguacgagauguccag

SEQ ID NO: 51233 - RNA, 20 nt, Artificial Sequence
  CIITA targeting sequence
ggcugcucugugagguacga

SEQ ID NO: 51234 - RNA, 20 nt, Artificial Sequence
  CIITA targeting sequence
gcaugucuggcugcucugug

SEQ ID NO: 51235 - RNA, 20 nt, Artificial Sequence
  CIITA targeting sequence
augccuggcauuuugcccuu

SEQ ID NO: 51236 - RNA, 20 nt, Artificial Sequence
  CIITA targeting sequence
gugcuuggcacaaugaccuc

SEQ ID NO: 51237 - RNA, 20 nt, Artificial Sequence
  CIITA targeting sequence
uugugccaagcaccgacucc

SEQ ID NO: 51238 - RNA, 20 nt, Artificial Sequence
  CIITA targeting sequence
ugucacagggcggauggacc

SEQ ID NO: 51239 - RNA, 20 nt, Artificial Sequence
  CIITA targeting sequence
cagggcggauggaccagccc

SEQ ID NO: 51240 - RNA, 20 nt, Artificial Sequence
  CIITA targeting sequence
gcccugugacaagaggucau

SEQ ID NO: 51241 - RNA, 20 nt, Artificial Sequence
  CIITA targeting sequence
auccgcccugugacaagagg

SEQ ID NO: 51242 - RNA, 20 nt, Artificial Sequence
  CIITA targeting sequence
acagcuuacuaaaccacagc

SEQ ID NO: 51243 - RNA, 20 nt, Artificial Sequence
  CIITA targeting sequence
ggcuguggcugugguuuagu

SEQ ID NO: 51244 - RNA, 20 nt, Artificial Sequence
  CIITA targeting sequence
acacaucuggcuguggcugu

SEQ ID NO: 51245 - RNA, 20 nt, Artificial Sequence
  CIITA targeting sequence
ccucccuaucuuggcagauc

SEQ ID NO: 51246 - RNA, 20 nt, Artificial Sequence
  CIITA targeting sequence
ucccuaucuuggcagauccu

SEQ ID NO: 51247 - RNA, 20 nt, Artificial Sequence
  CIITA targeting sequence
cuaucuuggcagauccucgu

SEQ ID NO: 51248 - RNA, 20 nt, Artificial Sequence
  CIITA targeting sequence
uggcagauccucguacccca

SEQ ID NO: 51249 - RNA, 20 nt, Artificial Sequence
  CIITA targeting sequence
gccaagauagggaggagaau

SEQ ID NO: 51250 - RNA, 20 nt, Artificial Sequence
  CIITA targeting sequence
ucguaccccaaaugugaggg

SEQ ID NO: 51251 - RNA, 20 nt, Artificial Sequence
  CIITA targeting sequence
uaccccaaaugugaggggcc

SEQ ID NO: 51252 - RNA, 20 nt, Artificial Sequence
  CIITA targeting sequence
cauuugggguacgaggaucu

SEQ ID NO: 51253 - RNA, 20 nt, Artificial Sequence
  CIITA targeting sequence
gggggaagucaagauccugg

SEQ ID NO: 51254 - RNA, 20 nt, Artificial Sequence
  CIITA targeting sequence
cccagaugcuggcugggccc

SEQ ID NO: 51255 - RNA, 20 nt, Artificial Sequence
  CIITA targeting sequence
agauccugguggcuuauggc

SEQ ID NO: 51256 - RNA, 20 nt, Artificial Sequence
  CIITA targeting sequence
ugacuucccccagaugcugg

SEQ ID NO: 51257 - RNA, 20 nt, Artificial Sequence
  CIITA targeting sequence
ugguggcuuauggcacuuag

SEQ ID NO: 51258 - RNA, 20 nt, Artificial Sequence
  CIITA targeting sequence
guuucucuuuccggcuuugg

SEQ ID NO: 51259 - RNA, 20 nt, Artificial Sequence
  CIITA targeting sequence
cuuuccggcuuugguggcgc

SEQ ID NO: 51260 - RNA, 20 nt, Artificial Sequence
  CIITA targeting sequence
uuccggcuuugguggcgccu

SEQ ID NO: 51261 - RNA, 20 nt, Artificial Sequence
  CIITA targeting sequence
ggcuuugguggcgccuugcu

SEQ ID NO: 51262 - RNA, 20 nt, Artificial Sequence
  CIITA targeting sequence
cagcaaggcgccaccaaagc

SEQ ID NO: 51263 - RNA, 20 nt, Artificial Sequence
  CIITA targeting sequence
uggccaggguguguaaucgu

SEQ ID NO: 51264 - RNA, 20 nt, Artificial Sequence
  CIITA targeting sequence
ugaaacuagccucugccccg

SEQ ID NO: 51265 - RNA, 20 nt, Artificial Sequence
  CIITA targeting sequence
cgauuacacacccuggccag

SEQ ID NO: 51266 - RNA, 20 nt, Artificial Sequence
  CIITA targeting sequence
gccccggaauuccucagccc

SEQ ID NO: 51267 - RNA, 20 nt, Artificial Sequence
  CIITA targeting sequence
ggggcagaggcuaguuucac

SEQ ID NO: 51268 - RNA, 20 nt, Artificial Sequence
  CIITA targeting sequence
ucagcccugcuuuuccucua

SEQ ID NO: 51269 - RNA, 20 nt, Artificial Sequence
  CIITA targeting sequence
gcccugcuuuuccucuaacc

SEQ ID NO: 51270 - RNA, 20 nt, Artificial Sequence
  CIITA targeting sequence
ucuaacccaugugucgggaa

SEQ ID NO: 51271 - RNA, 20 nt, Artificial Sequence
  CIITA targeting sequence
aacccaugugucgggaaggu

SEQ ID NO: 51272 - RNA, 20 nt, Artificial Sequence
  CIITA targeting sequence
ggaagguucccaugggaguc

SEQ ID NO: 51273 - RNA, 20 nt, Artificial Sequence
  CIITA targeting sequence
cgacacauggguuagaggaa

SEQ ID NO: 51274 - RNA, 20 nt, Artificial Sequence
  CIITA targeting sequence
caugggagucugugccccug

SEQ ID NO: 51275 - RNA, 20 nt, Artificial Sequence
  CIITA targeting sequence
caugggaaccuucccgacac

SEQ ID NO: 51276 - RNA, 20 nt, Artificial Sequence
  CIITA targeting sequence
gugccccugggaaccccgag

SEQ ID NO: 51277 - RNA, 20 nt, Artificial Sequence
  CIITA targeting sequence
caggggcacagacucccaug

SEQ ID NO: 51278 - RNA, 20 nt, Artificial Sequence
  CIITA targeting sequence
ggguucccaggggcacagac

SEQ ID NO: 51279 - RNA, 20 nt, Artificial Sequence
  CIITA targeting sequence
caguguggauucugcugacc

SEQ ID NO: 51280 - RNA, 20 nt, Artificial Sequence
  CIITA targeting sequence
agacgcugauccugucucau

SEQ ID NO: 51281 - RNA, 20 nt, Artificial Sequence
  CIITA targeting sequence
gggucaagacgcugauccug

SEQ ID NO: 51282 - RNA, 20 nt, Artificial Sequence
  CIITA targeting sequence
uugcagggcccaagcaaguc

SEQ ID NO: 51283 - RNA, 20 nt, Artificial Sequence
  CIITA targeting sequence
cacagguccuugcagggccc

SEQ ID NO: 51284 - RNA, 20 nt, Artificial Sequence
  CIITA targeting sequence
gggccccucucaccuccaga

SEQ ID NO: 51285 - RNA, 20 nt, Artificial Sequence
  CIITA targeting sequence
caccuccagacagggcggcu

SEQ ID NO: 51286 - RNA, 20 nt, Artificial Sequence
  CIITA targeting sequence
ccuccagacagggcggcucc

SEQ ID NO: 51287 - RNA, 20 nt, Artificial Sequence
  CIITA targeting sequence
agacagggcggcuccucccc

SEQ ID NO: 51288 - RNA, 20 nt, Artificial Sequence
  CIITA targeting sequence
ggaggugagaggggcccaga

SEQ ID NO: 51289 - RNA, 20 nt, Artificial Sequence
  CIITA targeting sequence
uccccacacccagcugggug

SEQ ID NO: 51290 - RNA, 20 nt, Artificial Sequence
  CIITA targeting sequence
ccacacccagcuggguggag

SEQ ID NO: 51291 - RNA, 20 nt, Artificial Sequence
  CIITA targeting sequence
acccagcuggguguggggag

SEQ ID NO: 51292 - RNA, 20 nt, Artificial Sequence
  CIITA targeting sequence
cccacuccacccagcugggu

SEQ ID NO: 51293 - RNA, 20 nt, Artificial Sequence
  CIITA targeting sequence
auacugcuggcccugugggc

SEQ ID NO: 51294 - RNA, 20 nt, Artificial Sequence
  CIITA targeting sequence
aauuacagggcccacagggc

SEQ ID NO: 51295 - RNA, 20 nt, Artificial Sequence
  CIITA targeting sequence
cuaauuacagggcccacagg

SEQ ID NO: 51296 - RNA, 20 nt, Artificial Sequence
  CIITA targeting sequence
cucuaauuacagggcccaca

SEQ ID NO: 51297 - RNA, 20 nt, Artificial Sequence
  CIITA targeting sequence
acuggaguucagcaucucua

SEQ ID NO: 51298 - RNA, 20 nt, Artificial Sequence
  CIITA targeting sequence
aguagaucucucuaauuaca

SEQ ID NO: 51299 - RNA, 20 nt, Artificial Sequence
  CIITA targeting sequence
gcaucucuaugaccuaggag

SEQ ID NO: 51300 - RNA, 20 nt, Artificial Sequence
  CIITA targeting sequence
cuaugaccuaggagaguccc

SEQ ID NO: 51301 - RNA, 20 nt, Artificial Sequence
  CIITA targeting sequence
augaccuaggagagucccua

SEQ ID NO: 51302 - RNA, 20 nt, Artificial Sequence
  CIITA targeting sequence
uagagaugcugaacuccagu

SEQ ID NO: 51303 - RNA, 20 nt, Artificial Sequence
  CIITA targeting sequence
uaggucauagagaugcugaa

SEQ ID NO: 51304 - RNA, 20 nt, Artificial Sequence
  CIITA targeting sequence
ccuaggucauagagaugcug

SEQ ID NO: 51305 - RNA, 20 nt, Artificial Sequence
  CIITA targeting sequence
cuacaaagagucucaggcuu

SEQ ID NO: 51306 - RNA, 20 nt, Artificial Sequence
  CIITA targeting sequence
uuguagggacucuccuaggu

SEQ ID NO: 51307 - RNA, 20 nt, Artificial Sequence
  CIITA targeting sequence
caggcuuccccucuguggag

SEQ ID NO: 51308 - RNA, 20 nt, Artificial Sequence
  CIITA targeting sequence
ggcuuccccucuguggagga

SEQ ID NO: 51309 - RNA, 20 nt, Artificial Sequence
  CIITA targeting sequence
ccucuguggaggaguccagg

SEQ ID NO: 51310 - RNA, 20 nt, Artificial Sequence
  CIITA targeting sequence
guggaggaguccaggguggg

SEQ ID NO: 51311 - RNA, 20 nt, Artificial Sequence
  CIITA targeting sequence
acagaggggaagccugagac

SEQ ID NO: 51312 - RNA, 20 nt, Artificial Sequence
  CIITA targeting sequence
uccacagaggggaagccuga

SEQ ID NO: 51313 - RNA, 20 nt, Artificial Sequence
  CIITA targeting sequence
agggugggggugagaggcuc

SEQ ID NO: 51314 - RNA, 20 nt, Artificial Sequence
  CIITA targeting sequence
cccccacccuggacuccucc

SEQ ID NO: 51315 - RNA, 20 nt, Artificial Sequence
  CIITA targeting sequence
cacccccacccuggacuccu

SEQ ID NO: 51316 - RNA, 20 nt, Artificial Sequence
  CIITA targeting sequence
gaggggcugcacucagaacc

SEQ ID NO: 51317 - RNA, 20 nt, Artificial Sequence
  CIITA targeting sequence
gagccucucacccccacccu

SEQ ID NO: 51318 - RNA, 20 nt, Artificial Sequence
  CIITA targeting sequence
gaaccugggucuuucauuua

SEQ ID NO: 51319 - RNA, 20 nt, Artificial Sequence
  CIITA targeting sequence
gagugcagccccucagagcc

SEQ ID NO: 51320 - RNA, 20 nt, Artificial Sequence
  CIITA targeting sequence
uucauuuauuuggcaaaucu

SEQ ID NO: 51321 - RNA, 20 nt, Artificial Sequence
  CIITA targeting sequence
uuuauuuggcaaaucuuaaa

SEQ ID NO: 51322 - RNA, 20 nt, Artificial Sequence
  CIITA targeting sequence
uaaaugucccaaguauucac

SEQ ID NO: 51323 - RNA, 20 nt, Artificial Sequence
  CIITA targeting sequence
caaguauucaccaagccuug

SEQ ID NO: 51324 - RNA, 20 nt, Artificial Sequence
  CIITA targeting sequence
ccaagccuugugcuggugcu

SEQ ID NO: 51325 - RNA, 20 nt, Artificial Sequence
  CIITA targeting sequence
ccccagcaccagcacaaggc

SEQ ID NO: 51326 - RNA, 20 nt, Artificial Sequence
  CIITA targeting sequence
gcuguccccccagcaccagc

SEQ ID NO: 51327 - RNA, 20 nt, Artificial Sequence
  CIITA targeting sequence
cugcuguccccccagcacca

SEQ ID NO: 51328 - RNA, 20 nt, Artificial Sequence
  CIITA targeting sequence
ggcucucugcugucccccca

SEQ ID NO: 51329 - RNA, 20 nt, Artificial Sequence
  CIITA targeting sequence
cagggggcuccucaucaaag

SEQ ID NO: 51330 - RNA, 20 nt, Artificial Sequence
  CIITA targeting sequence
ucaucaaaggggaggccuac

SEQ ID NO: 51331 - RNA, 20 nt, Artificial Sequence
  CIITA targeting sequence
ucaaaggggaggccuacagu

SEQ ID NO: 51332 - RNA, 20 nt, Artificial Sequence
  CIITA targeting sequence
aaggggaggccuacaguaaa

SEQ ID NO: 51333 - RNA, 20 nt, Artificial Sequence
  CIITA targeting sequence
ccuuugaugaggagcccccu

SEQ ID NO: 51334 - RNA, 20 nt, Artificial Sequence
  CIITA targeting sequence
auauuuauuuguguaauuau

SEQ ID NO: 51335 - RNA, 20 nt, Artificial Sequence
  CIITA targeting sequence
uuuucuauauuuauuugugu

SEQ ID NO: 51336 - RNA, 20 nt, Artificial Sequence
  CIITA targeting sequence
cuuggggaggcgugggucuu

SEQ ID NO: 51337 - RNA, 20 nt, Artificial Sequence
  CIITA targeting sequence
ccaagugacaguucauuuuc

SEQ ID NO: 51338 - RNA, 20 nt, Artificial Sequence
  CIITA targeting sequence
uggagugggguuuugaggug

SEQ ID NO: 51339 - RNA, 20 nt, Artificial Sequence
  CIITA targeting sequence
aagacccacgccuccccaag

SEQ ID NO: 51340 - RNA, 20 nt, Artificial Sequence
  CIITA targeting sequence
aaaccccacuccaagaccca

SEQ ID NO: 51341 - RNA, 20 nt, Artificial Sequence
  CIITA targeting sequence
caccucaaaaccccacucca

SEQ ID NO: 51342 - RNA, 20 nt, Artificial Sequence
  CIITA targeting sequence
uauucacaccucaaaacccc

SEQ ID NO: 51343 - RNA, 20 nt, Artificial Sequence
  CIITA targeting sequence
caaagccucagaggaagggg

SEQ ID NO: 51344 - RNA, 20 nt, Artificial Sequence
  CIITA targeting sequence
gaggaaggggaaggacuacg

SEQ ID NO: 51345 - RNA, 20 nt, Artificial Sequence
  CIITA targeting sequence
gaggcuuugugaacuccuau

SEQ ID NO: 51346 - RNA, 20 nt, Artificial Sequence
  CIITA targeting sequence
ucugaggcuuugugaacucc

SEQ ID NO: 51347 - RNA, 20 nt, Artificial Sequence
  CIITA targeting sequence
ccuuccucugaggcuuugug

SEQ ID NO: 51348 - RNA, 20 nt, Artificial Sequence
  CIITA targeting sequence
uuccccuuccucugaggcuu

SEQ ID NO: 51349 - RNA, 20 nt, Artificial Sequence
  CIITA targeting sequence
uaaaaaucucacuggaaaug

SEQ ID NO: 51350 - RNA, 20 nt, Artificial Sequence
  CIITA targeting sequence
cacuggaaaugaaaaacacu

SEQ ID NO: 51351 - RNA, 20 nt, Artificial Sequence
  CIITA targeting sequence
cuggaaaugaaaaacacuuu

SEQ ID NO: 51352 - RNA, 20 nt, Artificial Sequence
  CIITA targeting sequence
agugagauuuuuaugaauaa

SEQ ID NO: 51353 - RNA, 20 nt, Artificial Sequence
  CIITA targeting sequence
uuuccagugagauuuuuaug

SEQ ID NO: 51354 - RNA, 20 nt, Artificial Sequence
  CIITA targeting sequence
aaguguuuuucauuuccagu

SEQ ID NO: 51355 - RNA, 20 nt, Artificial Sequence
  CIITA targeting sequence
gcugucuguugucagacuac

SEQ ID NO: 51356 - RNA, 20 nt, Artificial Sequence
  CIITA targeting sequence
guugucagacuacccaaaua

SEQ ID NO: 51357 - RNA, 20 nt, Artificial Sequence
  CIITA targeting sequence
gacuacccaaauaccauugc

SEQ ID NO: 51358 - RNA, 20 nt, Artificial Sequence
  CIITA targeting sequence
gacaacagacagcggaaccc

SEQ ID NO: 51359 - RNA, 20 nt, Artificial Sequence
  CIITA targeting sequence
uggcaaugguauuuggguag

SEQ ID NO: 51360 - RNA, 20 nt, Artificial Sequence
  CIITA targeting sequence
agcaggcccacacagcagag

SEQ ID NO: 51361 - RNA, 20 nt, Artificial Sequence
  CIITA targeting sequence
gcugugugggccugcuggaa

SEQ ID NO: 51362 - RNA, 20 nt, Artificial Sequence
  CIITA targeting sequence
agggccaaauaacuucaaaa

SEQ ID NO: 51363 - RNA, 20 nt, Artificial Sequence
  CIITA targeting sequence
aaaaguaaaauuagaaaagc

SEQ ID NO: 51364 - RNA, 20 nt, Artificial Sequence
  CIITA targeting sequence
aauuuuacuuuuugaaguua

SEQ ID NO: 51365 - RNA, 20 nt, Artificial Sequence
  CIITA targeting sequence
cugaaaaguagcuguacacc

SEQ ID NO: 51366 - RNA, 20 nt, Artificial Sequence
  CIITA targeting sequence
gaaaaguagcuguacaccua

SEQ ID NO: 51367 - RNA, 20 nt, Artificial Sequence
  CIITA targeting sequence
gagaggcuuuucuaauuuua

SEQ ID NO: 51368 - RNA, 20 nt, Artificial Sequence
  CIITA targeting sequence
auguuuaauguggcccauag

SEQ ID NO: 51369 - RNA, 20 nt, Artificial Sequence
  CIITA targeting sequence
augggccacauuaaacauag

SEQ ID NO: 51370 - RNA, 20 nt, Artificial Sequence
  CIITA targeting sequence
gauguggauugggguccccc

SEQ ID NO: 51371 - RNA, 20 nt, Artificial Sequence
  CIITA targeting sequence
gagcaaaccuacaaaacaca

SEQ ID NO: 51372 - RNA, 20 nt, Artificial Sequence
  CIITA targeting sequence
acaucagagcaaaccuacaa

SEQ ID NO: 51373 - RNA, 20 nt, Artificial Sequence
  CIITA targeting sequence
cccaagcaguuguaccaguc

SEQ ID NO: 51374 - RNA, 20 nt, Artificial Sequence
  CIITA targeting sequence
caccucugagcuccuaaagc

SEQ ID NO: 51375 - RNA, 20 nt, Artificial Sequence
  CIITA targeting sequence
gagcuccuaaagcagcucug

SEQ ID NO: 51376 - RNA, 20 nt, Artificial Sequence
  CIITA targeting sequence
gaggugugacugguacaacu

SEQ ID NO: 51377 - RNA, 20 nt, Artificial Sequence
  CIITA targeting sequence
uaaagcagcucuggcagcca

SEQ ID NO: 51378 - RNA, 20 nt, Artificial Sequence
  CIITA targeting sequence
ggcagccaggcaggaaaacc

SEQ ID NO: 51379 - RNA, 20 nt, Artificial Sequence
  CIITA targeting sequence
ugccuggcugccagagcugc

SEQ ID NO: 51380 - RNA, 20 nt, Artificial Sequence
  CIITA targeting sequence
uauaaaguuaaacauucacc

SEQ ID NO: 51381 - RNA, 20 nt, Artificial Sequence
  CIITA targeting sequence
ccuacgcugagacccagcag

SEQ ID NO: 51382 - RNA, 20 nt, Artificial Sequence
  CIITA targeting sequence
gcguaggugaauguuuaacu

SEQ ID NO: 51383 - RNA, 20 nt, Artificial Sequence
  CIITA targeting sequence
cagcguaggugaauguuuaa

SEQ ID NO: 51384 - RNA, 20 nt, Artificial Sequence
  CIITA targeting sequence
cacucucagguauuuaccca

SEQ ID NO: 51385 - RNA, 20 nt, Artificial Sequence
  CIITA targeting sequence
cagguauuuacccaagagca

SEQ ID NO: 51386 - RNA, 20 nt, Artificial Sequence
  CIITA targeting sequence
gguauuuacccaagagcaaa

SEQ ID NO: 51387 - RNA, 20 nt, Artificial Sequence
  CIITA targeting sequence
uggguaaauaccugagagug

SEQ ID NO: 51388 - RNA, 20 nt, Artificial Sequence
  CIITA targeting sequence
uugcucuuggguaaauaccu

SEQ ID NO: 51389 - RNA, 20 nt, Artificial Sequence
  CIITA targeting sequence
agaucugugcacagauauuc

SEQ ID NO: 51390 - RNA, 20 nt, Artificial Sequence
  CIITA targeting sequence
ugaugggcacaugcuuucuu

SEQ ID NO: 51391 - RNA, 20 nt, Artificial Sequence
  CIITA targeting sequence
gugcacagauauucauagga

SEQ ID NO: 51392 - RNA, 20 nt, Artificial Sequence
  CIITA targeting sequence
gugcacagaucuugaugggc

SEQ ID NO: 51393 - RNA, 20 nt, Artificial Sequence
  CIITA targeting sequence
uaggagcucugcuccuaaua

SEQ ID NO: 51394 - RNA, 20 nt, Artificial Sequence
  CIITA targeting sequence
uaugaauaucugugcacaga

SEQ ID NO: 51395 - RNA, 20 nt, Artificial Sequence
  CIITA targeting sequence
gcuccuaauaaucccaaacu

SEQ ID NO: 51396 - RNA, 20 nt, Artificial Sequence
  CIITA targeting sequence
uaauaaucccaaacugggaa

SEQ ID NO: 51397 - RNA, 20 nt, Artificial Sequence
  CIITA targeting sequence
caaacugggaaacgucccaa

SEQ ID NO: 51398 - RNA, 20 nt, Artificial Sequence
  CIITA targeting sequence
caguuugggauuauuaggag

SEQ ID NO: 51399 - RNA, 20 nt, Artificial Sequence
  CIITA targeting sequence
caaauauccaucaacaguga

SEQ ID NO: 51400 - RNA, 20 nt, Artificial Sequence
  CIITA targeting sequence
aucaacagugagaauggaua

SEQ ID NO: 51401 - RNA, 20 nt, Artificial Sequence
  CIITA targeting sequence
acagugagaauggauaaaca

SEQ ID NO: 51402 - RNA, 20 nt, Artificial Sequence
  CIITA targeting sequence
cuguugauggauauuuggga

SEQ ID NO: 51403 - RNA, 20 nt, Artificial Sequence
  CIITA targeting sequence
cacuguugauggauauuugg

SEQ ID NO: 51404 - RNA, 20 nt, Artificial Sequence
  CIITA targeting sequence
auucucacuguugauggaua

SEQ ID NO: 51405 - RNA, 20 nt, Artificial Sequence
  CIITA targeting sequence
auuuguuuauccauucucac

SEQ ID NO: 51406 - RNA, 20 nt, Artificial Sequence
  CIITA targeting sequence
auacaaugggacacugcucc

SEQ ID NO: 51407 - RNA, 20 nt, Artificial Sequence
  CIITA targeting sequence
cauuguauggagguaccuca

SEQ ID NO: 51408 - RNA, 20 nt, Artificial Sequence
  CIITA targeting sequence
ccaauaaaacauugcaaacc

SEQ ID NO: 51409 - RNA, 20 nt, Artificial Sequence
  CIITA targeting sequence
ugcaccgcucucgcacgugu

SEQ ID NO: 51410 - RNA, 20 nt, Artificial Sequence
  CIITA targeting sequence
cgcacguguuguguugugug

SEQ ID NO: 51411 - RNA, 20 nt, Artificial Sequence
  CIITA targeting sequence
cacguguuguguugugugaa

SEQ ID NO: 51412 - RNA, 20 nt, Artificial Sequence
  CIITA targeting sequence
cacaacacaacacgugcgag

SEQ ID NO: 51413 - RNA, 20 nt, Artificial Sequence
  CIITA targeting sequence
gguuuguuucacacaacaca

SEQ ID NO: 51414 - RNA, 20 nt, Artificial Sequence
  CIITA targeting sequence
ugucugguuuguuucacaca

SEQ ID NO: 51415 - RNA, 20 nt, Artificial Sequence
  CIITA targeting sequence
cuucuugucugguuuguuuc

SEQ ID NO: 51416 - RNA, 20 nt, Artificial Sequence
  CIITA targeting sequence
caagugacugauugguuuau

SEQ ID NO: 51417 - RNA, 20 nt, Artificial Sequence
  CIITA targeting sequence
cuugggaugcgucccuucuu

SEQ ID NO: 51418 - RNA, 20 nt, Artificial Sequence
  CIITA targeting sequence
gucacuugggaugcgucccu

SEQ ID NO: 51419 - RNA, 20 nt, Artificial Sequence
  CIITA targeting sequence
uaaacuguacauaaaccaau

SEQ ID NO: 51420 - RNA, 20 nt, Artificial Sequence
  CIITA targeting sequence
cacugcuauuuauagauggc

SEQ ID NO: 51421 - RNA, 20 nt, Artificial Sequence
  CIITA targeting sequence
cugcuauuuauagauggcac

SEQ ID NO: 51422 - RNA, 20 nt, Artificial Sequence
  CIITA targeting sequence
auaaauagcagugagauuug

SEQ ID NO: 51423 - RNA, 20 nt, Artificial Sequence
  CIITA targeting sequence
gcuaguggggccgggggucg

SEQ ID NO: 51424 - RNA, 20 nt, Artificial Sequence
  CIITA targeting sequence
cuuguguacugggaaggggc

SEQ ID NO: 51425 - RNA, 20 nt, Artificial Sequence
  CIITA targeting sequence
caguacacaagcgacccccg

SEQ ID NO: 51426 - RNA, 20 nt, Artificial Sequence
  CIITA targeting sequence
agggaaccuucuggaggcug

SEQ ID NO: 51427 - RNA, 20 nt, Artificial Sequence
  CIITA targeting sequence
cuggagccccuucccaguac

SEQ ID NO: 51428 - RNA, 20 nt, Artificial Sequence
  CIITA targeting sequence
ggaggcugagggugcccuug

SEQ ID NO: 51429 - RNA, 20 nt, Artificial Sequence
  CIITA targeting sequence
agaagguucccuggagcccc

SEQ ID NO: 51430 - RNA, 20 nt, Artificial Sequence
  CIITA targeting sequence
gccuccagaagguucccugg

SEQ ID NO: 51431 - RNA, 20 nt, Artificial Sequence
  CIITA targeting sequence
agggcacccucagccuccag

SEQ ID NO: 51432 - RNA, 20 nt, Artificial Sequence
  CIITA targeting sequence
ugauuugaguggugacuaua

SEQ ID NO: 51433 - RNA, 20 nt, Artificial Sequence
  CIITA targeting sequence
ggaucaagggcacccucagc

SEQ ID NO: 51434 - RNA, 20 nt, Artificial Sequence
  CIITA targeting sequence
aaucaggaucaagggcaccc

SEQ ID NO: 51435 - RNA, 20 nt, Artificial Sequence
  CIITA targeting sequence
ccacucaaaucaggaucaag

SEQ ID NO: 51436 - RNA, 20 nt, Artificial Sequence
  CIITA targeting sequence
uuuuuuauaccuauauaguc

SEQ ID NO: 51437 - RNA, 20 nt, Artificial Sequence
  CIITA targeting sequence
agcuggacacuuaaagucaa

SEQ ID NO: 51438 - RNA, 20 nt, Artificial Sequence
  CIITA targeting sequence
agcuugaucauuuuuuauac

SEQ ID NO: 51439 - RNA, 20 nt, Artificial Sequence
  CIITA targeting sequence
acauaguuuaugcacuuuca

SEQ ID NO: 51440 - RNA, 20 nt, Artificial Sequence
  CIITA targeting sequence
cguguaaacauuauuccuua

SEQ ID NO: 51441 - RNA, 20 nt, Artificial Sequence
  CIITA targeting sequence
uuaagaaaauaaaaacagca

SEQ ID NO: 51442 - RNA, 20 nt, Artificial Sequence
  CIITA targeting sequence
uaaggaauaauguuuacacg

SEQ ID NO: 51443 - RNA, 20 nt, Artificial Sequence
  CIITA targeting sequence
ccccuucccugcagacuccc

SEQ ID NO: 51444 - RNA, 20 nt, Artificial Sequence
  CIITA targeting sequence
cugcagacucccccgacacc

SEQ ID NO: 51445 - RNA, 20 nt, Artificial Sequence
  CIITA targeting sequence
gcagggaaggggggagccac

SEQ ID NO: 51446 - RNA, 20 nt, Artificial Sequence
  CIITA targeting sequence
cccgacaccaccaccuccuu

SEQ ID NO: 51447 - RNA, 20 nt, Artificial Sequence
  CIITA targeting sequence
ggggagucugcagggaaggg

SEQ ID NO: 51448 - RNA, 20 nt, Artificial Sequence
  CIITA targeting sequence
uucuucgccuugcaucggua

SEQ ID NO: 51449 - RNA, 20 nt, Artificial Sequence
  CIITA targeting sequence
ucgccuugcaucgguacgau

SEQ ID NO: 51450 - RNA, 20 nt, Artificial Sequence
  CIITA targeting sequence
ccuugcaucgguacgauaag

SEQ ID NO: 51451 - RNA, 20 nt, Artificial Sequence
  CIITA targeting sequence
guacgauaaggcacuugcuu

SEQ ID NO: 51452 - RNA, 20 nt, Artificial Sequence
  CIITA targeting sequence
uaccgaugcaaggcgaagaa

SEQ ID NO: 51453 - RNA, 20 nt, Artificial Sequence
  CIITA targeting sequence
agcaagugccuuaucguacc

SEQ ID NO: 51454 - RNA, 20 nt, Artificial Sequence
  CIITA targeting sequence
cgucaagcaagugccuuauc

SEQ ID NO: 51455 - RNA, 20 nt, Artificial Sequence
  CIITA targeting sequence
uucccgucaagcaagugccu

SEQ ID NO: 51456 - RNA, 20 nt, Artificial Sequence
  CIITA targeting sequence
cuuucccgucaagcaagugc

SEQ ID NO: 51457 - RNA, 20 nt, Artificial Sequence
  CIITA targeting sequence
gcugccagcugggguucauu

SEQ ID NO: 51458 - RNA, 20 nt, Artificial Sequence
  CIITA targeting sequence
uuugcacuuucccccgccug

SEQ ID NO: 51459 - RNA, 20 nt, Artificial Sequence
  CIITA targeting sequence
cccgccuggucugcggucug

SEQ ID NO: 51460 - RNA, 20 nt, Artificial Sequence
  CIITA targeting sequence
gcggucuggcugugcagcua

SEQ ID NO: 51461 - RNA, 20 nt, Artificial Sequence
  CIITA targeting sequence
ggcugugcagcuagccgcuc

SEQ ID NO: 51462 - RNA, 20 nt, Artificial Sequence
  CIITA targeting sequence
gacggggaggaggggcccaa

SEQ ID NO: 51463 - RNA, 20 nt, Artificial Sequence
  CIITA targeting sequence
gagcggcuagcugcacagcc

SEQ ID NO: 51464 - RNA, 20 nt, Artificial Sequence
  CIITA targeting sequence
ccgucagagcggcuagcugc

SEQ ID NO: 51465 - RNA, 20 nt, Artificial Sequence
  CIITA targeting sequence
uccccgucagagcggcuagc

SEQ ID NO: 51466 - RNA, 20 nt, Artificial Sequence
  CIITA targeting sequence
ccugcccaggcggcaggcag

SEQ ID NO: 51467 - RNA, 20 nt, Artificial Sequence
  CIITA targeting sequence
ccccugcccaggcggcaggc

SEQ ID NO: 51468 - RNA, 20 nt, Artificial Sequence
  CIITA targeting sequence
cgugccccucuccccugccc

SEQ ID NO: 51469 - RNA, 20 nt, Artificial Sequence
  CIITA targeting sequence
uggcagaggcacagccagcu

SEQ ID NO: 51470 - RNA, 20 nt, Artificial Sequence
  CIITA targeting sequence
gccaugagccucacgugccc

SEQ ID NO: 51471 - RNA, 20 nt, Artificial Sequence
  CIITA targeting sequence
ugcaugugcccuccccgggg

SEQ ID NO: 51472 - RNA, 20 nt, Artificial Sequence
  CIITA targeting sequence
ccggggaaugucugcagagc

SEQ ID NO: 51473 - RNA, 20 nt, Artificial Sequence
  CIITA targeting sequence
ccggggagggcacaugcaag

SEQ ID NO: 51474 - RNA, 20 nt, Artificial Sequence
  CIITA targeting sequence
gcagagcccaagacugccac

SEQ ID NO: 51475 - RNA, 20 nt, Artificial Sequence
  CIITA targeting sequence
gcagacauuccccggggagg

SEQ ID NO: 51476 - RNA, 20 nt, Artificial Sequence
  CIITA targeting sequence
ugggcucugcagacauuccc

SEQ ID NO: 51477 - RNA, 20 nt, Artificial Sequence
  CIITA targeting sequence
ccaugcucuacuucucagcu

SEQ ID NO: 51478 - RNA, 20 nt, Artificial Sequence
  CIITA targeting sequence
acuucucagcugcagcccca

SEQ ID NO: 51479 - RNA, 20 nt, Artificial Sequence
  CIITA targeting sequence
cagcugcagccccacggccu

SEQ ID NO: 51480 - RNA, 20 nt, Artificial Sequence
  CIITA targeting sequence
gcugcagccccacggccugg

SEQ ID NO: 51481 - RNA, 20 nt, Artificial Sequence
  CIITA targeting sequence
aggccguggggcugcagcug

SEQ ID NO: 51482 - RNA, 20 nt, Artificial Sequence
  CIITA targeting sequence
cuugcccaggccccccagcc

SEQ ID NO: 51483 - RNA, 20 nt, Artificial Sequence
  CIITA targeting sequence
ugggccccucccugaaaccu

SEQ ID NO: 51484 - RNA, 20 nt, Artificial Sequence
  CIITA targeting sequence
cugaaaccuccagacacaaa

SEQ ID NO: 51485 - RNA, 20 nt, Artificial Sequence
  CIITA targeting sequence
gggaggggcccaggauuugu

SEQ ID NO: 51486 - RNA, 20 nt, Artificial Sequence
  CIITA targeting sequence
agacacaaacucacuucagg

SEQ ID NO: 51487 - RNA, 20 nt, Artificial Sequence
  CIITA targeting sequence
ggagguuucagggaggggcc

SEQ ID NO: 51488 - RNA, 20 nt, Artificial Sequence
  CIITA targeting sequence
cuucaggcuggggccuuggu

SEQ ID NO: 51489 - RNA, 20 nt, Artificial Sequence
  CIITA targeting sequence
ggcuggggccuugguuuccc

SEQ ID NO: 51490 - RNA, 20 nt, Artificial Sequence
  CIITA targeting sequence
ccaucuggaaaaggggugaa

SEQ ID NO: 51491 - RNA, 20 nt, Artificial Sequence
  CIITA targeting sequence
ggaaaaggggugaaaagccc

SEQ ID NO: 51492 - RNA, 20 nt, Artificial Sequence
  CIITA targeting sequence
agauggggaaaccaaggccc

SEQ ID NO: 51493 - RNA, 20 nt, Artificial Sequence
  CIITA targeting sequence
ccccuuuuccagauggggaa

SEQ ID NO: 51494 - RNA, 20 nt, Artificial Sequence
  CIITA targeting sequence
uuccaguguagcagucgagg

SEQ ID NO: 51495 - RNA, 20 nt, Artificial Sequence
  CIITA targeting sequence
aguguagcagucgaggcauu

SEQ ID NO: 51496 - RNA, 20 nt, Artificial Sequence
  CIITA targeting sequence
aggcauuugcagcagguguu

SEQ ID NO: 51497 - RNA, 20 nt, Artificial Sequence
  CIITA targeting sequence
acugcuacacuggaaagaug

SEQ ID NO: 51498 - RNA, 20 nt, Artificial Sequence
  CIITA targeting sequence
guguaucgauguaggaggcu

SEQ ID NO: 51499 - RNA, 20 nt, Artificial Sequence
  CIITA targeting sequence
auguaggaggcucucaaaaa

SEQ ID NO: 51500 - RNA, 20 nt, Artificial Sequence
  CIITA targeting sequence
auacacugagcacaaacacc

SEQ ID NO: 51501 - RNA, 20 nt, Artificial Sequence
  CIITA targeting sequence
uacaucgauacacugagcac

SEQ ID NO: 51502 - RNA, 20 nt, Artificial Sequence
  CIITA targeting sequence
caaaaaggauguagaaaaca

SEQ ID NO: 51503 - RNA, 20 nt, Artificial Sequence
  CIITA targeting sequence
aaaaggauguagaaaacaug

SEQ ID NO: 51504 - RNA, 20 nt, Artificial Sequence
  CIITA targeting sequence
uuuuugagagccuccuacau

SEQ ID NO: 51505 - RNA, 20 nt, Artificial Sequence
  CIITA targeting sequence
acauccuuuuugagagccuc

SEQ ID NO: 51506 - RNA, 20 nt, Artificial Sequence
  CIITA targeting sequence
uguuuucuacauccuuuuug

SEQ ID NO: 51507 - RNA, 20 nt, Artificial Sequence
  CIITA targeting sequence
uaacuauucauguuuucuac

SEQ ID NO: 51508 - RNA, 20 nt, Artificial Sequence
  CIITA targeting sequence
uguuuuaauaaaauuagaau

SEQ ID NO: 51509 - RNA, 20 nt, Artificial Sequence
  CIITA targeting sequence
aauuuuauuaaaacaggacu

SEQ ID NO: 51510 - RNA, 20 nt, Artificial Sequence
  CIITA targeting sequence
cagcuacucaugaggcugag

SEQ ID NO: 51511 - RNA, 20 nt, Artificial Sequence
  CIITA targeting sequence
ugaggcugaggcgggaggau

SEQ ID NO: 51512 - RNA, 20 nt, Artificial Sequence
  CIITA targeting sequence
ugaguagcugggauuauagg

SEQ ID NO: 51513 - RNA, 20 nt, Artificial Sequence
  CIITA targeting sequence
gccucaugaguagcugggau

SEQ ID NO: 51514 - RNA, 20 nt, Artificial Sequence
  CIITA targeting sequence
cgccucagccucaugaguag

SEQ ID NO: 51515 - RNA, 20 nt, Artificial Sequence
  CIITA targeting sequence
ucccgccucagccucaugag

SEQ ID NO: 51516 - RNA, 20 nt, Artificial Sequence
  CIITA targeting sequence
cuugagcccaguucaagccc

SEQ ID NO: 51517 - RNA, 20 nt, Artificial Sequence
  CIITA targeting sequence
agugauccucccgccucagc

SEQ ID NO: 51518 - RNA, 20 nt, Artificial Sequence
  CIITA targeting sequence
agcccagccugggcagcaug

SEQ ID NO: 51519 - RNA, 20 nt, Artificial Sequence
  CIITA targeting sequence
ugcugcccaggcugggcuug

SEQ ID NO: 51520 - RNA, 20 nt, Artificial Sequence
  CIITA targeting sequence
ucaugcugcccaggcugggc

SEQ ID NO: 51521 - RNA, 20 nt, Artificial Sequence
  CIITA targeting sequence
cuacacaaaauacaaaacau

SEQ ID NO: 51522 - RNA, 20 nt, Artificial Sequence
  CIITA targeting sequence
acacaaaauacaaaacauag

SEQ ID NO: 51523 - RNA, 20 nt, Artificial Sequence
  CIITA targeting sequence
gcuauguuuuguauuuugug

SEQ ID NO: 51524 - RNA, 20 nt, Artificial Sequence
  CIITA targeting sequence
cuagcuacuagggaagcuga

SEQ ID NO: 51525 - RNA, 20 nt, Artificial Sequence
  CIITA targeting sequence
cuaguagcuagggaguacgc

SEQ ID NO: 51526 - RNA, 20 nt, Artificial Sequence
  CIITA targeting sequence
gcuucccuaguagcuaggga

SEQ ID NO: 51527 - RNA, 20 nt, Artificial Sequence
  CIITA targeting sequence
caccucagcuucccuaguag

SEQ ID NO: 51528 - RNA, 20 nt, Artificial Sequence
  CIITA targeting sequence
ucccaccucagcuucccuag

SEQ ID NO: 51529 - RNA, 20 nt, Artificial Sequence
  CIITA targeting sequence
agcaaucuucccaccucagc

SEQ ID NO: 51530 - RNA, 20 nt, Artificial Sequence
  CIITA targeting sequence
ugggcucaagcaaucuuccc

SEQ ID NO: 51531 - RNA, 20 nt, Artificial Sequence
  CIITA targeting sequence
aacucaugggcucaagcaau

SEQ ID NO: 51532 - RNA, 20 nt, Artificial Sequence
  CIITA targeting sequence
aagcuuacugcagccucaaa

SEQ ID NO: 51533 - RNA, 20 nt, Artificial Sequence
  CIITA targeting sequence
cacaagugcacucuagccug

SEQ ID NO: 51534 - RNA, 20 nt, Artificial Sequence
  CIITA targeting sequence
agccuggguuacaaaaaaua

SEQ ID NO: 51535 - RNA, 20 nt, Artificial Sequence
  CIITA targeting sequence
cagcuauaaucccagcucuu

SEQ ID NO: 51536 - RNA, 20 nt, Artificial Sequence
  CIITA targeting sequence
cagcucuuugugaggcugag

SEQ ID NO: 51537 - RNA, 20 nt, Artificial Sequence
  CIITA targeting sequence
uugugaggcugaggugggag

SEQ ID NO: 51538 - RNA, 20 nt, Artificial Sequence
  CIITA targeting sequence
caaagagcugggauuauagc

SEQ ID NO: 51539 - RNA, 20 nt, Artificial Sequence
  CIITA targeting sequence
gccucacaaagagcugggau

SEQ ID NO: 51540 - RNA, 20 nt, Artificial Sequence
  CIITA targeting sequence
caccucagccucacaaagag

SEQ ID NO: 51541 - RNA, 20 nt, Artificial Sequence
  CIITA targeting sequence
ucccaccucagccucacaaa

SEQ ID NO: 51542 - RNA, 20 nt, Artificial Sequence
  CIITA targeting sequence
cuuaagcucaggaguuugag

SEQ ID NO: 51543 - RNA, 20 nt, Artificial Sequence
  CIITA targeting sequence
ggaguuugagaccagucugg

SEQ ID NO: 51544 - RNA, 20 nt, Artificial Sequence
  CIITA targeting sequence
ugagcuuaagugauccuccc

SEQ ID NO: 51545 - RNA, 20 nt, Artificial Sequence
  CIITA targeting sequence
aacuccugagcuuaagugau

SEQ ID NO: 51546 - RNA, 20 nt, Artificial Sequence
  CIITA targeting sequence
caaacuccugagcuuaagug

SEQ ID NO: 51547 - RNA, 20 nt, Artificial Sequence
  CIITA targeting sequence
gggcaacacagcaagacccc

SEQ ID NO: 51548 - RNA, 20 nt, Artificial Sequence
  CIITA targeting sequence
ugcuguguugcccagacugg

SEQ ID NO: 51549 - RNA, 20 nt, Artificial Sequence
  CIITA targeting sequence
cuacaaaaaaauuuuuaaaa

SEQ ID NO: 51550 - RNA, 20 nt, Artificial Sequence
  CIITA targeting sequence
acaaaaaaauuuuuaaaaaa

SEQ ID NO: 51551 - RNA, 20 nt, Artificial Sequence
  CIITA targeting sequence
cagauacucaggagcuugag

SEQ ID NO: 51552 - RNA, 20 nt, Artificial Sequence
  CIITA targeting sequence
gggacuacaggcacacgcca

SEQ ID NO: 51553 - RNA, 20 nt, Artificial Sequence
  CIITA targeting sequence
ggagcuugagguggaaggau

SEQ ID NO: 51554 - RNA, 20 nt, Artificial Sequence
  CIITA targeting sequence
ugaguaucugggacuacagg

SEQ ID NO: 51555 - RNA, 20 nt, Artificial Sequence
  CIITA targeting sequence
agcuccugaguaucugggac

SEQ ID NO: 51556 - RNA, 20 nt, Artificial Sequence
  CIITA targeting sequence
accucaagcuccugaguauc

SEQ ID NO: 51557 - RNA, 20 nt, Artificial Sequence
  CIITA targeting sequence
uuccaccucaagcuccugag

SEQ ID NO: 51558 - RNA, 20 nt, Artificial Sequence
  CIITA targeting sequence
cuggagcccaggaguucaag

SEQ ID NO: 51559 - RNA, 20 nt, Artificial Sequence
  CIITA targeting sequence
agugauccuuccaccucaag

SEQ ID NO: 51560 - RNA, 20 nt, Artificial Sequence
  CIITA targeting sequence
ugggcuccagugauccuucc

SEQ ID NO: 51561 - RNA, 20 nt, Artificial Sequence
  CIITA targeting sequence
aggcugcagugagcuaugau

SEQ ID NO: 51562 - RNA, 20 nt, Artificial Sequence
  CIITA targeting sequence
cugcagccuugaacuccugg

SEQ ID NO: 51563 - RNA, 20 nt, Artificial Sequence
  CIITA targeting sequence
uagcucacugcagccuugaa

SEQ ID NO: 51564 - RNA, 20 nt, Artificial Sequence
  CIITA targeting sequence
agccugggugacagaaagac

SEQ ID NO: 51565 - RNA, 20 nt, Artificial Sequence
  CIITA targeting sequence
cccaggcuggagugcaaugg

SEQ ID NO: 51566 - RNA, 20 nt, Artificial Sequence
  CIITA targeting sequence
gucacccaggcuggagugca

SEQ ID NO: 51567 - RNA, 20 nt, Artificial Sequence
  CIITA targeting sequence
uucugucacccaggcuggag

SEQ ID NO: 51568 - RNA, 20 nt, Artificial Sequence
  CIITA targeting sequence
uuaaaaaacaaacaaacaaa

SEQ ID NO: 51569 - RNA, 20 nt, Artificial Sequence
  CIITA targeting sequence
uuuuguuuguuuguuuguuu

SEQ ID NO: 51570 - RNA, 20 nt, Artificial Sequence
  CIITA targeting sequence
cucuuuuuguuuguuuguuu

SEQ ID NO: 51571 - RNA, 20 nt, Artificial Sequence
  CIITA targeting sequence
uucacucuuuuuguuuguuu

SEQ ID NO: 51572 - RNA, 20 nt, Artificial Sequence
  CIITA targeting sequence
auuuauuuuuaaauuuaauu

SEQ ID NO: 51573 - RNA, 20 nt, Artificial Sequence
  CIITA targeting sequence
aguucuauuuauuuuuaaau

SEQ ID NO: 51574 - RNA, 20 nt, Artificial Sequence
  CIITA targeting sequence
ucuaguucuauuuauuuuua

SEQ ID NO: 51575 - RNA, 20 nt, Artificial Sequence
  CIITA targeting sequence
ucuucuaguucuauuuauuu

SEQ ID NO: 51576 - RNA, 20 nt, Artificial Sequence
  CIITA targeting sequence
gaauguguucaucugagaag

SEQ ID NO: 51577 - RNA, 20 nt, Artificial Sequence
  CIITA targeting sequence
gaaauaguuugggcuuccuc

SEQ ID NO: 51578 - RNA, 20 nt, Artificial Sequence
  CIITA targeting sequence
ucugagaagagggcaaaaug

SEQ ID NO: 51579 - RNA, 20 nt, Artificial Sequence
  CIITA targeting sequence
gagaagagggcaaaauguaa

SEQ ID NO: 51580 - RNA, 20 nt, Artificial Sequence
  CIITA targeting sequence
gaugaacacauucagaaaua

SEQ ID NO: 51581 - RNA, 20 nt, Artificial Sequence
  CIITA targeting sequence
cagaugaacacauucagaaa

SEQ ID NO: 51582 - RNA, 20 nt, Artificial Sequence
  CIITA targeting sequence
ucucagaugaacacauucag

SEQ ID NO: 51583 - RNA, 20 nt, Artificial Sequence
  CIITA targeting sequence
ccauuauuuucccccgaagu

SEQ ID NO: 51584 - RNA, 20 nt, Artificial Sequence
  CIITA targeting sequence
cccgaaguucggauuaaaga

SEQ ID NO: 51585 - RNA, 20 nt, Artificial Sequence
  CIITA targeting sequence
ggggaaaauaauggugaaac

SEQ ID NO: 51586 - RNA, 20 nt, Artificial Sequence
  CIITA targeting sequence
gauuaaagaaagggagggga

SEQ ID NO: 51587 - RNA, 20 nt, Artificial Sequence
  CIITA targeting sequence
gaacuucgggggaaaauaau

SEQ ID NO: 51588 - RNA, 20 nt, Artificial Sequence
  CIITA targeting sequence
uuaauccgaacuucggggga

SEQ ID NO: 51589 - RNA, 20 nt, Artificial Sequence
  CIITA targeting sequence
cuuucuuuaauccgaacuuc

SEQ ID NO: 51590 - RNA, 20 nt, Artificial Sequence
  CIITA targeting sequence
ccucccuuucuuuaauccga

SEQ ID NO: 51591 - RNA, 20 nt, Artificial Sequence
  CIITA targeting sequence
acacaccucccuuuguccug

SEQ ID NO: 51592 - RNA, 20 nt, Artificial Sequence
  CIITA targeting sequence
cuuuguccugggugucgugc

SEQ ID NO: 51593 - RNA, 20 nt, Artificial Sequence
  CIITA targeting sequence
ugggugucgugcuucagcau

SEQ ID NO: 51594 - RNA, 20 nt, Artificial Sequence
  CIITA targeting sequence
ugcuucagcauguguggaug

SEQ ID NO: 51595 - RNA, 20 nt, Artificial Sequence
  CIITA targeting sequence
gcauguguggaugguagcuu

SEQ ID NO: 51596 - RNA, 20 nt, Artificial Sequence
  CIITA targeting sequence
acacaugcugaagcacgaca

SEQ ID NO: 51597 - RNA, 20 nt, Artificial Sequence
  CIITA targeting sequence
uuuuuuuuuuuaaccacaaa

SEQ ID NO: 51598 - RNA, 20 nt, Artificial Sequence
  CIITA targeting sequence
ucuuuuuuuuuuuuaaccac

SEQ ID NO: 51599 - RNA, 20 nt, Artificial Sequence
  CIITA targeting sequence
ucuucuuuuuuuuuuuuaac

SEQ ID NO: 51600 - RNA, 20 nt, Artificial Sequence
  CIITA targeting sequence
uuucuucuucuuuuuuuuuu

SEQ ID NO: 51601 - RNA, 20 nt, Artificial Sequence
  CIITA targeting sequence
cauuucuucuucuuuuuuuu

SEQ ID NO: 51602 - RNA, 20 nt, Artificial Sequence
  CIITA targeting sequence
aaguacuuuuugcucucauu

SEQ ID NO: 51603 - RNA, 20 nt, Artificial Sequence
  CIITA targeting sequence
caaaguacuuuuugcucuca

SEQ ID NO: 51604 - RNA, 20 nt, Artificial Sequence
  CIITA targeting sequence
uuguagcugucacgucccca

SEQ ID NO: 51605 - RNA, 20 nt, Artificial Sequence
  CIITA targeting sequence
cguccccagacccuguggug

SEQ ID NO: 51606 - RNA, 20 nt, Artificial Sequence
  CIITA targeting sequence
ccagacccuguggugagaac

SEQ ID NO: 51607 - RNA, 20 nt, Artificial Sequence
  CIITA targeting sequence
ggggacgugacagcuacaaa

SEQ ID NO: 51608 - RNA, 20 nt, Artificial Sequence
  CIITA targeting sequence
ccacagggucuggggacgug

SEQ ID NO: 51609 - RNA, 20 nt, Artificial Sequence
  CIITA targeting sequence
caccacagggucuggggacg

SEQ ID NO: 51610 - RNA, 20 nt, Artificial Sequence
  CIITA targeting sequence
agggacaccugugaacaugc

SEQ ID NO: 51611 - RNA, 20 nt, Artificial Sequence
  CIITA targeting sequence
cuggagguucucaccacagg

SEQ ID NO: 51612 - RNA, 20 nt, Artificial Sequence
  CIITA targeting sequence
caggugucccuggagguucu

SEQ ID NO: 51613 - RNA, 20 nt, Artificial Sequence
  CIITA targeting sequence
caggcccagccucagggguc

SEQ ID NO: 51614 - RNA, 20 nt, Artificial Sequence
  CIITA targeting sequence
ggggucugcacguuuaagaa

SEQ ID NO: 51615 - RNA, 20 nt, Artificial Sequence
  CIITA targeting sequence
gcacguuuaagaaauggaug

SEQ ID NO: 51616 - RNA, 20 nt, Artificial Sequence
  CIITA targeting sequence
uaaacgugcagaccccugag

SEQ ID NO: 51617 - RNA, 20 nt, Artificial Sequence
  CIITA targeting sequence
auuucuuaaacgugcagacc

SEQ ID NO: 51618 - RNA, 20 nt, Artificial Sequence
  CIITA targeting sequence
aaugaugagggcaauggugc

SEQ ID NO: 51619 - RNA, 20 nt, Artificial Sequence
  CIITA targeting sequence
uuagacaagugcauccauuu

SEQ ID NO: 51620 - RNA, 20 nt, Artificial Sequence
  CIITA targeting sequence
ucauuagacaagugcaucca

SEQ ID NO: 51621 - RNA, 20 nt, Artificial Sequence
  CIITA targeting sequence
ggcaccauugcccucaucau

SEQ ID NO: 51622 - RNA, 20 nt, Artificial Sequence
  CIITA targeting sequence
gcucucuaggacaagcccuu

SEQ ID NO: 51623 - RNA, 20 nt, Artificial Sequence
  CIITA targeting sequence
cuaggacaagcccuugagac

SEQ ID NO: 51624 - RNA, 20 nt, Artificial Sequence
  CIITA targeting sequence
aggacaagcccuugagacaa

SEQ ID NO: 51625 - RNA, 20 nt, Artificial Sequence
  CIITA targeting sequence
uagagagcagacacgugggc

SEQ ID NO: 51626 - RNA, 20 nt, Artificial Sequence
  CIITA targeting sequence
agggcuuguccuagagagca

SEQ ID NO: 51627 - RNA, 20 nt, Artificial Sequence
  CIITA targeting sequence
caagggcuuguccuagagag

SEQ ID NO: 51628 - RNA, 20 nt, Artificial Sequence
  CIITA targeting sequence
uuaucccguuuaaagacgag

SEQ ID NO: 51629 - RNA, 20 nt, Artificial Sequence
  CIITA targeting sequence
cguuuaaagacgagaaaacu

SEQ ID NO: 51630 - RNA, 20 nt, Artificial Sequence
  CIITA targeting sequence
uuaaacgggauaaugauacu

SEQ ID NO: 51631 - RNA, 20 nt, Artificial Sequence
  CIITA targeting sequence
ucuuuaaacgggauaaugau

SEQ ID NO: 51632 - RNA, 20 nt, Artificial Sequence
  CIITA targeting sequence
cgucuuuaaacgggauaaug

SEQ ID NO: 51633 - RNA, 20 nt, Artificial Sequence
  CIITA targeting sequence
cuccuguaaucccagcacuu

SEQ ID NO: 51634 - RNA, 20 nt, Artificial Sequence
  CIITA targeting sequence
uguaaucccagcacuuuggg

SEQ ID NO: 51635 - RNA, 20 nt, Artificial Sequence
  CIITA targeting sequence
cagcacuuugggaggccgag

SEQ ID NO: 51636 - RNA, 20 nt, Artificial Sequence
  CIITA targeting sequence
caaagugcugggauuacagg

SEQ ID NO: 51637 - RNA, 20 nt, Artificial Sequence
  CIITA targeting sequence
gccucccaaagugcugggau

SEQ ID NO: 51638 - RNA, 20 nt, Artificial Sequence
  CIITA targeting sequence
acccaccucggccucccaaa

SEQ ID NO: 51639 - RNA, 20 nt, Artificial Sequence
  CIITA targeting sequence
ccugaggucaggaguucaag

SEQ ID NO: 51640 - RNA, 20 nt, Artificial Sequence
  CIITA targeting sequence
ggugauccacccaccucggc

SEQ ID NO: 51641 - RNA, 20 nt, Artificial Sequence
  CIITA targeting sequence
ggaguucaagaccagacugg

SEQ ID NO: 51642 - RNA, 20 nt, Artificial Sequence
  CIITA targeting sequence
ugaccucaggugauccaccc

SEQ ID NO: 51643 - RNA, 20 nt, Artificial Sequence
  CIITA targeting sequence
agaccagacuggccaacaug

SEQ ID NO: 51644 - RNA, 20 nt, Artificial Sequence
  CIITA targeting sequence
ugaacuccugaccucaggug

SEQ ID NO: 51645 - RNA, 20 nt, Artificial Sequence
  CIITA targeting sequence
ggucuugaacuccugaccuc

SEQ ID NO: 51646 - RNA, 20 nt, Artificial Sequence
  CIITA targeting sequence
ccauguuggccagucugguc

SEQ ID NO: 51647 - RNA, 20 nt, Artificial Sequence
  CIITA targeting sequence
cuacuaaaaauacaaagauu

SEQ ID NO: 51648 - RNA, 20 nt, Artificial Sequence
  CIITA targeting sequence
acuaaaaauacaaagauuag

SEQ ID NO: 51649 - RNA, 20 nt, Artificial Sequence
  CIITA targeting sequence
uuguauuuuuaguagagaca

SEQ ID NO: 51650 - RNA, 20 nt, Artificial Sequence
  CIITA targeting sequence
agcuacucaggaggcugagg

SEQ ID NO: 51651 - RNA, 20 nt, Artificial Sequence
  CIITA targeting sequence
ggaggcugaggcgggagaau

SEQ ID NO: 51652 - RNA, 20 nt, Artificial Sequence
  CIITA targeting sequence
ugaguagcuggaauuacagg

SEQ ID NO: 51653 - RNA, 20 nt, Artificial Sequence
  CIITA targeting sequence
gccuccugaguagcuggaau

SEQ ID NO: 51654 - RNA, 20 nt, Artificial Sequence
  CIITA targeting sequence
cgccucagccuccugaguag

SEQ ID NO: 51655 - RNA, 20 nt, Artificial Sequence
  CIITA targeting sequence
cccgccucagccuccugagu

SEQ ID NO: 51656 - RNA, 20 nt, Artificial Sequence
  CIITA targeting sequence
cuugaacccaggaggcagaa

SEQ ID NO: 51657 - RNA, 20 nt, Artificial Sequence
  CIITA targeting sequence
agcgauucucccgccucagc

SEQ ID NO: 51658 - RNA, 20 nt, Artificial Sequence
  CIITA targeting sequence
uggguucaagcgauucuccc

SEQ ID NO: 51659 - RNA, 20 nt, Artificial Sequence
  CIITA targeting sequence
gccuccuggguucaagcgau

SEQ ID NO: 51660 - RNA, 20 nt, Artificial Sequence
  CIITA targeting sequence
cugcaacuucugccuccugg

SEQ ID NO: 51661 - RNA, 20 nt, Artificial Sequence
  CIITA targeting sequence
gcucacugcaacuucugccu

SEQ ID NO: 51662 - RNA, 20 nt, Artificial Sequence
  CIITA targeting sequence
cagcucacugcaacuucugc

SEQ ID NO: 51663 - RNA, 20 nt, Artificial Sequence
  CIITA targeting sequence
ugccacugcacuccagccug

SEQ ID NO: 51664 - RNA, 20 nt, Artificial Sequence
  CIITA targeting sequence
agccugggccacagcaugac

SEQ ID NO: 51665 - RNA, 20 nt, Artificial Sequence
  CIITA targeting sequence
ugcuguggcccaggcuggag

SEQ ID NO: 51666 - RNA, 20 nt, Artificial Sequence
  CIITA targeting sequence
gucucaaaaaauaauaauaa

SEQ ID NO: 51667 - RNA, 20 nt, Artificial Sequence
  CIITA targeting sequence
caaaaaauaauaauaauaac

SEQ ID NO: 51668 - RNA, 20 nt, Artificial Sequence
  CIITA targeting sequence
aaaaauaauaauaauaacac

SEQ ID NO: 51669 - RNA, 20 nt, Artificial Sequence
  CIITA targeting sequence
uuauuauuuuguguuauuau

SEQ ID NO: 51670 - RNA, 20 nt, Artificial Sequence
  CIITA targeting sequence
ucuuuauuauuuuguguuau

SEQ ID NO: 51671 - RNA, 20 nt, Artificial Sequence
  CIITA targeting sequence
ucaucuuuauuauuuugugu

SEQ ID NO: 51672 - RNA, 20 nt, Artificial Sequence
  CIITA targeting sequence
ccucaucuuuauuauuuugu

SEQ ID NO: 51673 - RNA, 20 nt, Artificial Sequence
  CIITA targeting sequence
gucuccucaucuuuauuauu

SEQ ID NO: 51674 - RNA, 20 nt, Artificial Sequence
  CIITA targeting sequence
aagccaugcuggccucaguc

SEQ ID NO: 51675 - RNA, 20 nt, Artificial Sequence
  CIITA targeting sequence
ggcgugagaguccacagucu

SEQ ID NO: 51676 - RNA, 20 nt, Artificial Sequence
  CIITA targeting sequence
cgccagaaucaaagccaugc

SEQ ID NO: 51677 - RNA, 20 nt, Artificial Sequence
  CIITA targeting sequence
cacgccagaaucaaagccau

SEQ ID NO: 51678 - RNA, 20 nt, Artificial Sequence
  CIITA targeting sequence
acagucuggaaguaucugau

SEQ ID NO: 51679 - RNA, 20 nt, Artificial Sequence
  CIITA targeting sequence
ggaaguaucugauuuggcac

SEQ ID NO: 51680 - RNA, 20 nt, Artificial Sequence
  CIITA targeting sequence
agacuguggacucucacgcc

SEQ ID NO: 51681 - RNA, 20 nt, Artificial Sequence
  CIITA targeting sequence
gauuuggcacuccuaucccu

SEQ ID NO: 51682 - RNA, 20 nt, Artificial Sequence
  CIITA targeting sequence
gauacuuccagacuguggac

SEQ ID NO: 51683 - RNA, 20 nt, Artificial Sequence
  CIITA targeting sequence
uaucccugaaggccccacuu

SEQ ID NO: 51684 - RNA, 20 nt, Artificial Sequence
  CIITA targeting sequence
cugaaggccccacuuuacag

SEQ ID NO: 51685 - RNA, 20 nt, Artificial Sequence
  CIITA targeting sequence
gggauaggagugccaaauca

SEQ ID NO: 51686 - RNA, 20 nt, Artificial Sequence
  CIITA targeting sequence
accuguaaaguggggccuuc

SEQ ID NO: 51687 - RNA, 20 nt, Artificial Sequence
  CIITA targeting sequence
guugguccaccuguaaagug

SEQ ID NO: 51688 - RNA, 20 nt, Artificial Sequence
  CIITA targeting sequence
gcuucaguugguccaccugu

SEQ ID NO: 51689 - RNA, 20 nt, Artificial Sequence
  CIITA targeting sequence
cucagcuucaguugguccac

SEQ ID NO: 51690 - RNA, 20 nt, Artificial Sequence
  CIITA targeting sequence
cccucagcuucaguuggucc

SEQ ID NO: 51691 - RNA, 20 nt, Artificial Sequence
  CIITA targeting sequence
ucucccucagcuucaguugg

SEQ ID NO: 51692 - RNA, 20 nt, Artificial Sequence
  CIITA targeting sequence
ggucaucucccucagcuuca

SEQ ID NO: 51693 - RNA, 20 nt, Artificial Sequence
  CIITA targeting sequence
aaggucagggccaaugaggg

SEQ ID NO: 51694 - RNA, 20 nt, Artificial Sequence
  CIITA targeting sequence
gggccaaugaggggcacuca

SEQ ID NO: 51695 - RNA, 20 nt, Artificial Sequence
  CIITA targeting sequence
uuggcccugaccuuggauaa

SEQ ID NO: 51696 - RNA, 20 nt, Artificial Sequence
  CIITA targeting sequence
ggucugagguucccuucauu

SEQ ID NO: 51697 - RNA, 20 nt, Artificial Sequence
  CIITA targeting sequence
gagguucccuucauuucccc

SEQ ID NO: 51698 - RNA, 20 nt, Artificial Sequence
  CIITA targeting sequence
gaccugagugccccucauug

SEQ ID NO: 51699 - RNA, 20 nt, Artificial Sequence
  CIITA targeting sequence
cuucauuucccccaggggaa

SEQ ID NO: 51700 - RNA, 20 nt, Artificial Sequence
  CIITA targeting sequence
uuucccccaggggaaccugg

SEQ ID NO: 51701 - RNA, 20 nt, Artificial Sequence
  CIITA targeting sequence
cccaggggaaccuggugaaa

SEQ ID NO: 51702 - RNA, 20 nt, Artificial Sequence
  CIITA targeting sequence
ccugggggaaaugaagggaa

SEQ ID NO: 51703 - RNA, 20 nt, Artificial Sequence
  CIITA targeting sequence
ccagguuccccugggggaaa

SEQ ID NO: 51704 - RNA, 20 nt, Artificial Sequence
  CIITA targeting sequence
auggcuuacuuucaccaggu

SEQ ID NO: 51705 - RNA, 20 nt, Artificial Sequence
  CIITA targeting sequence
cccccagacucuucucuugu

SEQ ID NO: 51706 - RNA, 20 nt, Artificial Sequence
  CIITA targeting sequence
gggggugaauccauggcuua

SEQ ID NO: 51707 - RNA, 20 nt, Artificial Sequence
  CIITA targeting sequence
ucucuugugcccugaaaccu

SEQ ID NO: 51708 - RNA, 20 nt, Artificial Sequence
  CIITA targeting sequence
cuugugcccugaaaccugau

SEQ ID NO: 51709 - RNA, 20 nt, Artificial Sequence
  CIITA targeting sequence
ugugcccugaaaccugauuu

SEQ ID NO: 51710 - RNA, 20 nt, Artificial Sequence
  CIITA targeting sequence
gggcacaagagaagagucug

SEQ ID NO: 51711 - RNA, 20 nt, Artificial Sequence
  CIITA targeting sequence
gguuucagggcacaagagaa

SEQ ID NO: 51712 - RNA, 20 nt, Artificial Sequence
  CIITA targeting sequence
cuaagacccacagccuagga

SEQ ID NO: 51713 - RNA, 20 nt, Artificial Sequence
  CIITA targeting sequence
aagacccacagccuaggaag

SEQ ID NO: 51714 - RNA, 20 nt, Artificial Sequence
  CIITA targeting sequence
uagagaaaucagguuucagg

SEQ ID NO: 51715 - RNA, 20 nt, Artificial Sequence
  CIITA targeting sequence
uaggcugugggucuuagaga

SEQ ID NO: 51716 - RNA, 20 nt, Artificial Sequence
  CIITA targeting sequence
cccuggcccagccuuccuag

SEQ ID NO: 51717 - RNA, 20 nt, Artificial Sequence
  CIITA targeting sequence
aggcucacccuggcccagcc

SEQ ID NO: 51718 - RNA, 20 nt, Artificial Sequence
  CIITA targeting sequence
cccgccauucccccacccac

SEQ ID NO: 51719 - RNA, 20 nt, Artificial Sequence
  CIITA targeting sequence
cccacccaccccaggccagc

SEQ ID NO: 51720 - RNA, 20 nt, Artificial Sequence
  CIITA targeting sequence
uuucuuguuuucugccaccg

SEQ ID NO: 51721 - RNA, 20 nt, Artificial Sequence
  CIITA targeting sequence
uguuuucugccaccgcuggg

SEQ ID NO: 51722 - RNA, 20 nt, Artificial Sequence
  CIITA targeting sequence
gccaccgcuggguguucugc

SEQ ID NO: 51723 - RNA, 20 nt, Artificial Sequence
  CIITA targeting sequence
gcucugacgaggaggcccca

SEQ ID NO: 51724 - RNA, 20 nt, Artificial Sequence
  CIITA targeting sequence
gacgaggaggccccagguaa

SEQ ID NO: 51725 - RNA, 20 nt, Artificial Sequence
  CIITA targeting sequence
gagcagaacacccagcggug

SEQ ID NO: 51726 - RNA, 20 nt, Artificial Sequence
  CIITA targeting sequence
ucagagcagaacacccagcg

SEQ ID NO: 51727 - RNA, 20 nt, Artificial Sequence
  CIITA targeting sequence
ucgucagagcagaacaccca

SEQ ID NO: 51728 - RNA, 20 nt, Artificial Sequence
  CIITA targeting sequence
ggcagccuuacuguuuaccu

SEQ ID NO: 51729 - RNA, 20 nt, Artificial Sequence
  CIITA targeting sequence
accuuccccaggccccccag

SEQ ID NO: 51730 - RNA, 20 nt, Artificial Sequence
  CIITA targeting sequence
agccagcagugcauguucag

SEQ ID NO: 51731 - RNA, 20 nt, Artificial Sequence
  CIITA targeting sequence
ccaggccccccagccacaaa

SEQ ID NO: 51732 - RNA, 20 nt, Artificial Sequence
  CIITA targeting sequence
ugggccccucccugaaaccu

SEQ ID NO: 51733 - RNA, 20 nt, Artificial Sequence
  CIITA targeting sequence
cugaaaccuccaaacacaag

SEQ ID NO: 51734 - RNA, 20 nt, Artificial Sequence
  CIITA targeting sequence
gggaggggcccaggauuugu

SEQ ID NO: 51735 - RNA, 20 nt, Artificial Sequence
  CIITA targeting sequence
aaacacaagacccaguuuug

SEQ ID NO: 51736 - RNA, 20 nt, Artificial Sequence
  CIITA targeting sequence
uguguuuggagguuucaggg

SEQ ID NO: 51737 - RNA, 20 nt, Artificial Sequence
  CIITA targeting sequence
aaugagucugcagagggagg

SEQ ID NO: 51738 - RNA, 20 nt, Artificial Sequence
  CIITA targeting sequence
uuugaugcaaaacugggucu

SEQ ID NO: 51739 - RNA, 20 nt, Artificial Sequence
  CIITA targeting sequence
gcagagggagggaaaggaag

SEQ ID NO: 51740 - RNA, 20 nt, Artificial Sequence
  CIITA targeting sequence
gcagacucauuugaugcaaa

SEQ ID NO: 51741 - RNA, 20 nt, Artificial Sequence
  CIITA targeting sequence
cucugcagacucauuugaug

SEQ ID NO: 51742 - RNA, 20 nt, Artificial Sequence
  CIITA targeting sequence
cucccucugcagacucauuu

SEQ ID NO: 51743 - RNA, 20 nt, Artificial Sequence
  CIITA targeting sequence
uuucccucccucugcagacu

SEQ ID NO: 51744 - RNA, 20 nt, Artificial Sequence
  CIITA targeting sequence
acaggcagcuuccuuucccu

SEQ ID NO: 51745 - RNA, 20 nt, Artificial Sequence
  CIITA targeting sequence
gguggaaccuggucaggugu

SEQ ID NO: 51746 - RNA, 20 nt, Artificial Sequence
  CIITA targeting sequence
accugacuccacaggcagcu

SEQ ID NO: 51747 - RNA, 20 nt, Artificial Sequence
  CIITA targeting sequence
gguguguuugugucucugag

SEQ ID NO: 51748 - RNA, 20 nt, Artificial Sequence
  CIITA targeting sequence
cugagccucaguuuccucau

SEQ ID NO: 51749 - RNA, 20 nt, Artificial Sequence
  CIITA targeting sequence
gagccucaguuuccucauuu

SEQ ID NO: 51750 - RNA, 20 nt, Artificial Sequence
  CIITA targeting sequence
gagacacaaacacaccugac

SEQ ID NO: 51751 - RNA, 20 nt, Artificial Sequence
  CIITA targeting sequence
guuuccucauuuggacacag

SEQ ID NO: 51752 - RNA, 20 nt, Artificial Sequence
  CIITA targeting sequence
ucauuuggacacagagcugg

SEQ ID NO: 51753 - RNA, 20 nt, Artificial Sequence
  CIITA targeting sequence
uuuggacacagagcugguaa

SEQ ID NO: 51754 - RNA, 20 nt, Artificial Sequence
  CIITA targeting sequence
aaaugaggaaacugaggcuc

SEQ ID NO: 51755 - RNA, 20 nt, Artificial Sequence
  CIITA targeting sequence
guguccaaaugaggaaacug

SEQ ID NO: 51756 - RNA, 20 nt, Artificial Sequence
  CIITA targeting sequence
uaccagcucuguguccaaau

SEQ ID NO: 51757 - RNA, 20 nt, Artificial Sequence
  CIITA targeting sequence
gccuuguagauucuauguaa

SEQ ID NO: 51758 - RNA, 20 nt, Artificial Sequence
  CIITA targeting sequence
acaaggcugaucuuaccagc

SEQ ID NO: 51759 - RNA, 20 nt, Artificial Sequence
  CIITA targeting sequence
auguaaggauuagaaacauc

SEQ ID NO: 51760 - RNA, 20 nt, Artificial Sequence
  CIITA targeting sequence
uuacauagaaucuacaaggc

SEQ ID NO: 51761 - RNA, 20 nt, Artificial Sequence
  CIITA targeting sequence
aauccuuacauagaaucuac

SEQ ID NO: 51762 - RNA, 20 nt, Artificial Sequence
  CIITA targeting sequence
ccaggguagggccuggcaca

SEQ ID NO: 51763 - RNA, 20 nt, Artificial Sequence
  CIITA targeting sequence
gcacaugugccaggcccuac

SEQ ID NO: 51764 - RNA, 20 nt, Artificial Sequence
  CIITA targeting sequence
cagcacaugugccaggcccu

SEQ ID NO: 51765 - RNA, 20 nt, Artificial Sequence
  CIITA targeting sequence
ggccucucagcacaugugcc

SEQ ID NO: 51766 - RNA, 20 nt, Artificial Sequence
  CIITA targeting sequence
agcagggggucuggagccca

SEQ ID NO: 51767 - RNA, 20 nt, Artificial Sequence
  CIITA targeting sequence
ggagcccagugcuugguuua

SEQ ID NO: 51768 - RNA, 20 nt, Artificial Sequence
  CIITA targeting sequence
agacccccugcuagaaccac

SEQ ID NO: 51769 - RNA, 20 nt, Artificial Sequence
  CIITA targeting sequence
cgguuuuugucauuacuuuc

SEQ ID NO: 51770 - RNA, 20 nt, Artificial Sequence
  CIITA targeting sequence
gaacgcuugggcccuccggc

SEQ ID NO: 51771 - RNA, 20 nt, Artificial Sequence
  CIITA targeting sequence
gaccauagcaauguguauua

SEQ ID NO: 51772 - RNA, 20 nt, Artificial Sequence
  CIITA targeting sequence
ggcaaugcauaugaugaaau

SEQ ID NO: 51773 - RNA, 20 nt, Artificial Sequence
  CIITA targeting sequence
uaugcauugccggagggccc

SEQ ID NO: 51774 - RNA, 20 nt, Artificial Sequence
  CIITA targeting sequence
ucauaugcauugccggaggg

SEQ ID NO: 51775 - RNA, 20 nt, Artificial Sequence
  CIITA targeting sequence
cacccccacugugauggugc

SEQ ID NO: 51776 - RNA, 20 nt, Artificial Sequence
  CIITA targeting sequence
cccccacugugauggugcau

SEQ ID NO: 51777 - RNA, 20 nt, Artificial Sequence
  CIITA targeting sequence
cagugggggugagaauuuca

SEQ ID NO: 51778 - RNA, 20 nt, Artificial Sequence
  CIITA targeting sequence
uaaugcaccaucacaguggg

SEQ ID NO: 51779 - RNA, 20 nt, Artificial Sequence
  CIITA targeting sequence
aaaggccccgccuccuaaug

SEQ ID NO: 51780 - RNA, 20 nt, Artificial Sequence
  CIITA targeting sequence
ccuuccaaaggccccgccuc

SEQ ID NO: 51781 - RNA, 20 nt, Artificial Sequence
  CIITA targeting sequence
ugagggcacagcccucauga

SEQ ID NO: 51782 - RNA, 20 nt, Artificial Sequence
  CIITA targeting sequence
ugaacuaaucaccuuccaaa

SEQ ID NO: 51783 - RNA, 20 nt, Artificial Sequence
  CIITA targeting sequence
ugaaugggauuagcacccuu

SEQ ID NO: 51784 - RNA, 20 nt, Artificial Sequence
  CIITA targeting sequence
ugagggcugugcccucauga

SEQ ID NO: 51785 - RNA, 20 nt, Artificial Sequence
  CIITA targeting sequence
cauucaugagggcugugccc

SEQ ID NO: 51786 - RNA, 20 nt, Artificial Sequence
  CIITA targeting sequence
caugagaacggguucacacc

SEQ ID NO: 51787 - RNA, 20 nt, Artificial Sequence
  CIITA targeting sequence
ugggauuguuuuauaagggu

SEQ ID NO: 51788 - RNA, 20 nt, Artificial Sequence
  CIITA targeting sequence
caugggauuguuuuauaagg

SEQ ID NO: 51789 - RNA, 20 nt, Artificial Sequence
  CIITA targeting sequence
caccuuucgccauuaaagau

SEQ ID NO: 51790 - RNA, 20 nt, Artificial Sequence
  CIITA targeting sequence
ccauuaaagauccaacaaga

SEQ ID NO: 51791 - RNA, 20 nt, Artificial Sequence
  CIITA targeting sequence
uuaauggcgaaaggugugaa

SEQ ID NO: 51792 - RNA, 20 nt, Artificial Sequence
  CIITA targeting sequence
aacaagaauccuucuuuccg

SEQ ID NO: 51793 - RNA, 20 nt, Artificial Sequence
  CIITA targeting sequence
uguuggaucuuuaauggcga

SEQ ID NO: 51794 - RNA, 20 nt, Artificial Sequence
  CIITA targeting sequence
uucuuuccggucugugaacc

SEQ ID NO: 51795 - RNA, 20 nt, Artificial Sequence
  CIITA targeting sequence
uuccggucugugaaccaaua

SEQ ID NO: 51796 - RNA, 20 nt, Artificial Sequence
  CIITA targeting sequence
ggucugugaaccaauaaaca

SEQ ID NO: 51797 - RNA, 20 nt, Artificial Sequence
  CIITA targeting sequence
gugaaccaauaaacaggccc

SEQ ID NO: 51798 - RNA, 20 nt, Artificial Sequence
  CIITA targeting sequence
cagaccggaaagaaggauuc

SEQ ID NO: 51799 - RNA, 20 nt, Artificial Sequence
  CIITA targeting sequence
gcugggggccuguuuauugg

SEQ ID NO: 51800 - RNA, 20 nt, Artificial Sequence
  CIITA targeting sequence
aaugucugcugggggccugu

SEQ ID NO: 51801 - RNA, 20 nt, Artificial Sequence
  CIITA targeting sequence
gccagcaccuucaucuugga

SEQ ID NO: 51802 - RNA, 20 nt, Artificial Sequence
  CIITA targeting sequence
ucuuggacuuuucagccucc

SEQ ID NO: 51803 - RNA, 20 nt, Artificial Sequence
  CIITA targeting sequence
uggacuuuucagccuccaga

SEQ ID NO: 51804 - RNA, 20 nt, Artificial Sequence
  CIITA targeting sequence
aagaugaaggugcuggcaga

SEQ ID NO: 51805 - RNA, 20 nt, Artificial Sequence
  CIITA targeting sequence
gccuccagaacuguaagaaa

SEQ ID NO: 51806 - RNA, 20 nt, Artificial Sequence
  CIITA targeting sequence
agaacuguaagaaauaaacg

SEQ ID NO: 51807 - RNA, 20 nt, Artificial Sequence
  CIITA targeting sequence
ggaggcugaaaaguccaaga

SEQ ID NO: 51808 - RNA, 20 nt, Artificial Sequence
  CIITA targeting sequence
uacaguucuggaggcugaaa

SEQ ID NO: 51809 - RNA, 20 nt, Artificial Sequence
  CIITA targeting sequence
ugccucuaaucccagcacuu

SEQ ID NO: 51810 - RNA, 20 nt, Artificial Sequence
  CIITA targeting sequence
aaucccagcacuuugggaga

SEQ ID NO: 51811 - RNA, 20 nt, Artificial Sequence
  CIITA targeting sequence
cagcacuuugggagauccga

SEQ ID NO: 51812 - RNA, 20 nt, Artificial Sequence
  CIITA targeting sequence
caaagugcugggauuagagg

SEQ ID NO: 51813 - RNA, 20 nt, Artificial Sequence
  CIITA targeting sequence
cccaaagugcugggauuaga

SEQ ID NO: 51814 - RNA, 20 nt, Artificial Sequence
  CIITA targeting sequence
gaggcagacagaucaccuga

SEQ ID NO: 51815 - RNA, 20 nt, Artificial Sequence
  CIITA targeting sequence
gaucucccaaagugcuggga

SEQ ID NO: 51816 - RNA, 20 nt, Artificial Sequence
  CIITA targeting sequence
gccucggaucucccaaagug

SEQ ID NO: 51817 - RNA, 20 nt, Artificial Sequence
  CIITA targeting sequence
gucugccucggaucucccaa

SEQ ID NO: 51818 - RNA, 20 nt, Artificial Sequence
  CIITA targeting sequence
ccugagggaaggaguucaag

SEQ ID NO: 51819 - RNA, 20 nt, Artificial Sequence
  CIITA targeting sequence
ggugaucugucugccucgga

SEQ ID NO: 51820 - RNA, 20 nt, Artificial Sequence
  CIITA targeting sequence
cucaggugaucugucugccu

SEQ ID NO: 51821 - RNA, 20 nt, Artificial Sequence
  CIITA targeting sequence
uucccucaggugaucugucu

SEQ ID NO: 51822 - RNA, 20 nt, Artificial Sequence
  CIITA targeting sequence
agaccagccuggccaacaug

SEQ ID NO: 51823 - RNA, 20 nt, Artificial Sequence
  CIITA targeting sequence
ugaacuccuucccucaggug

SEQ ID NO: 51824 - RNA, 20 nt, Artificial Sequence
  CIITA targeting sequence
uguuggccaggcuggucuug

SEQ ID NO: 51825 - RNA, 20 nt, Artificial Sequence
  CIITA targeting sequence
ucauguuggccaggcugguc

SEQ ID NO: 51826 - RNA, 20 nt, Artificial Sequence
  CIITA targeting sequence
gucucuccuaaaaguacaaa

SEQ ID NO: 51827 - RNA, 20 nt, Artificial Sequence
  CIITA targeting sequence
cuccuaaaaguacaaacauu

SEQ ID NO: 51828 - RNA, 20 nt, Artificial Sequence
  CIITA targeting sequence
ccuaaaaguacaaacauugc

SEQ ID NO: 51829 - RNA, 20 nt, Artificial Sequence
  CIITA targeting sequence
uaaaaguacaaacauugccc

SEQ ID NO: 51830 - RNA, 20 nt, Artificial Sequence
  CIITA targeting sequence
guaaucccagccacucggga

SEQ ID NO: 51831 - RNA, 20 nt, Artificial Sequence
  CIITA targeting sequence
cagccacucgggaggcugag

SEQ ID NO: 51832 - RNA, 20 nt, Artificial Sequence
  CIITA targeting sequence
ggaggcugaggcaggagaau

SEQ ID NO: 51833 - RNA, 20 nt, Artificial Sequence
  CIITA targeting sequence
cgaguggcugggauuacaga

SEQ ID NO: 51834 - RNA, 20 nt, Artificial Sequence
  CIITA targeting sequence
gccucccgaguggcugggau

SEQ ID NO: 51835 - RNA, 20 nt, Artificial Sequence
  CIITA targeting sequence
ugccucagccucccgagugg

SEQ ID NO: 51836 - RNA, 20 nt, Artificial Sequence
  CIITA targeting sequence
ccugccucagccucccgagu

SEQ ID NO: 51837 - RNA, 20 nt, Artificial Sequence
  CIITA targeting sequence
cuugaaccuggaggcggagg

SEQ ID NO: 51838 - RNA, 20 nt, Artificial Sequence
  CIITA targeting sequence
agugauucuccugccucagc

SEQ ID NO: 51839 - RNA, 20 nt, Artificial Sequence
  CIITA targeting sequence
agguucaagugauucuccug

SEQ ID NO: 51840 - RNA, 20 nt, Artificial Sequence
  CIITA targeting sequence
gccuccagguucaagugauu

SEQ ID NO: 51841 - RNA, 20 nt, Artificial Sequence
  CIITA targeting sequence
gcuuacuacaaccuccgccu

SEQ ID NO: 51842 - RNA, 20 nt, Artificial Sequence
  CIITA targeting sequence
cagcuuacuacaaccuccgc

SEQ ID NO: 51843 - RNA, 20 nt, Artificial Sequence
  CIITA targeting sequence
agccugggcaauagggugag

SEQ ID NO: 51844 - RNA, 20 nt, Artificial Sequence
  CIITA targeting sequence
cccuauugcccaggcuggag

SEQ ID NO: 51845 - RNA, 20 nt, Artificial Sequence
  CIITA targeting sequence
cacccuauugcccaggcugg

SEQ ID NO: 51846 - RNA, 20 nt, Artificial Sequence
  CIITA targeting sequence
cucuuaaaaaaaaaaaagaa

SEQ ID NO: 51847 - RNA, 20 nt, Artificial Sequence
  CIITA targeting sequence
cuuaaaaaaaaaaaagaaga

SEQ ID NO: 51848 - RNA, 20 nt, Artificial Sequence
  CIITA targeting sequence
uaaaaaaaaaaaagaagaag

SEQ ID NO: 51849 - RNA, 20 nt, Artificial Sequence
  CIITA targeting sequence
uuuuuuuuuuuaagagagag

SEQ ID NO: 51850 - RNA, 20 nt, Artificial Sequence
  CIITA targeting sequence
ucuuuuuuuuuuuuaagaga

SEQ ID NO: 51851 - RNA, 20 nt, Artificial Sequence
  CIITA targeting sequence
ucuucuuuuuuuuuuuuaag

SEQ ID NO: 51852 - RNA, 20 nt, Artificial Sequence
  CIITA targeting sequence
ucuucuucuuuuuuuuuuuu

SEQ ID NO: 51853 - RNA, 20 nt, Artificial Sequence
  CIITA targeting sequence
ucuucuucuucuuuuuuuuu

SEQ ID NO: 51854 - RNA, 20 nt, Artificial Sequence
  CIITA targeting sequence
cuucuucuucuucuuuuuuu

SEQ ID NO: 51855 - RNA, 20 nt, Artificial Sequence
  CIITA targeting sequence
uucucuucuucuucuucuuu

SEQ ID NO: 51856 - RNA, 20 nt, Artificial Sequence
  CIITA targeting sequence
guuguugauaaacucccuag

SEQ ID NO: 51857 - RNA, 20 nt, Artificial Sequence
  CIITA targeting sequence
acaacagaaauuucuuucuc

SEQ ID NO: 51858 - RNA, 20 nt, Artificial Sequence
  CIITA targeting sequence
cuaguuuaugguaguuuguu

SEQ ID NO: 51859 - RNA, 20 nt, Artificial Sequence
  CIITA targeting sequence
gggcugcuauaacaaacuac

SEQ ID NO: 51860 - RNA, 20 nt, Artificial Sequence
  CIITA targeting sequence
aucugggcugcuauaacaaa

SEQ ID NO: 51861 - RNA, 20 nt, Artificial Sequence
  CIITA targeting sequence
uagucaaucugggcugcuau

SEQ ID NO: 51862 - RNA, 20 nt, Artificial Sequence
  CIITA targeting sequence
acuacauguuaucuuaguca

SEQ ID NO: 51863 - RNA, 20 nt, Artificial Sequence
  CIITA targeting sequence
gcccuaaacaggaagagaac

SEQ ID NO: 51864 - RNA, 20 nt, Artificial Sequence
  CIITA targeting sequence
uguuuagggcugaauuauau

SEQ ID NO: 51865 - RNA, 20 nt, Artificial Sequence
  CIITA targeting sequence
uccuguuuagggcugaauua

SEQ ID NO: 51866 - RNA, 20 nt, Artificial Sequence
  CIITA targeting sequence
cuuccuguuuagggcugaau

SEQ ID NO: 51867 - RNA, 20 nt, Artificial Sequence
  CIITA targeting sequence
gacacaugcaacagcaugga

SEQ ID NO: 51868 - RNA, 20 nt, Artificial Sequence
  CIITA targeting sequence
gaguucucuuccuguuuagg

SEQ ID NO: 51869 - RNA, 20 nt, Artificial Sequence
  CIITA targeting sequence
augcuguugcaugugucaga

SEQ ID NO: 51870 - RNA, 20 nt, Artificial Sequence
  CIITA targeting sequence
aggacauuaugcaaagugaa

SEQ ID NO: 51871 - RNA, 20 nt, Artificial Sequence
  CIITA targeting sequence
uugaggcacauccaugcugu

SEQ ID NO: 51872 - RNA, 20 nt, Artificial Sequence
  CIITA targeting sequence
cuuugcauaauguccuugag

SEQ ID NO: 51873 - RNA, 20 nt, Artificial Sequence
  CIITA targeting sequence
uucacuuugcauaauguccu

SEQ ID NO: 51874 - RNA, 20 nt, Artificial Sequence
  CIITA targeting sequence
uaaaaggacacaggucauuu

SEQ ID NO: 51875 - RNA, 20 nt, Artificial Sequence
  CIITA targeting sequence
uuuuaugacuggcuucuuuc

SEQ ID NO: 51876 - RNA, 20 nt, Artificial Sequence
  CIITA targeting sequence
uuugauuccacucacaggag

SEQ ID NO: 51877 - RNA, 20 nt, Artificial Sequence
  CIITA targeting sequence
aaugaccuguguccuuuuau

SEQ ID NO: 51878 - RNA, 20 nt, Artificial Sequence
  CIITA targeting sequence
acucacaggagguacccgga

SEQ ID NO: 51879 - RNA, 20 nt, Artificial Sequence
  CIITA targeting sequence
caggagguacccggagaagu

SEQ ID NO: 51880 - RNA, 20 nt, Artificial Sequence
  CIITA targeting sequence
ugugaguggaaucaaaugac

SEQ ID NO: 51881 - RNA, 20 nt, Artificial Sequence
  CIITA targeting sequence
ggguaccuccugugagugga

SEQ ID NO: 51882 - RNA, 20 nt, Artificial Sequence
  CIITA targeting sequence
ccggguaccuccugugagug

SEQ ID NO: 51883 - RNA, 20 nt, Artificial Sequence
  CIITA targeting sequence
gauucagagaaacagaaagu

SEQ ID NO: 51884 - RNA, 20 nt, Artificial Sequence
  CIITA targeting sequence
gacuucuccggguaccuccu

SEQ ID NO: 51885 - RNA, 20 nt, Artificial Sequence
  CIITA targeting sequence
gagaaacagaaaguggaaua

SEQ ID NO: 51886 - RNA, 20 nt, Artificial Sequence
  CIITA targeting sequence
gaauccgacuucuccgggua

SEQ ID NO: 51887 - RNA, 20 nt, Artificial Sequence
  CIITA targeting sequence
cugaauccgacuucuccggg

SEQ ID NO: 51888 - RNA, 20 nt, Artificial Sequence
  CIITA targeting sequence
guuucucugaauccgacuuc

SEQ ID NO: 51889 - RNA, 20 nt, Artificial Sequence
  CIITA targeting sequence
acuuucuguuucucugaauc

SEQ ID NO: 51890 - RNA, 20 nt, Artificial Sequence
  CIITA targeting sequence
ugccccagcaaccacuauuc

SEQ ID NO: 51891 - RNA, 20 nt, Artificial Sequence
  CIITA targeting sequence
cuccugccccagcaaccacu

SEQ ID NO: 51892 - RNA, 20 nt, Artificial Sequence
  CIITA targeting sequence
ccucccuccugccccagcaa

SEQ ID NO: 51893 - RNA, 20 nt, Artificial Sequence
  CIITA targeting sequence
cauuuccccucccuccugcc

SEQ ID NO: 51894 - RNA, 20 nt, Artificial Sequence
  CIITA targeting sequence
accuguuaagcaacucccau

SEQ ID NO: 51895 - RNA, 20 nt, Artificial Sequence
  CIITA targeting sequence
guuuuguaacaugaaaagag

SEQ ID NO: 51896 - RNA, 20 nt, Artificial Sequence
  CIITA targeting sequence
uguuacaaaacugaaccuuu

SEQ ID NO: 51897 - RNA, 20 nt, Artificial Sequence
  CIITA targeting sequence
uuucauguuacaaaacugaa

SEQ ID NO: 51898 - RNA, 20 nt, Artificial Sequence
  CIITA targeting sequence
ggagcugcauggcgguuaug

SEQ ID NO: 51899 - RNA, 20 nt, Artificial Sequence
  CIITA targeting sequence
agaacucuuuucauguuaca

SEQ ID NO: 51900 - RNA, 20 nt, Artificial Sequence
  CIITA targeting sequence
gaacugugcccuucaaaugg

SEQ ID NO: 51901 - RNA, 20 nt, Artificial Sequence
  CIITA targeting sequence
gaaauguuaaguacauuuuu

SEQ ID NO: 51902 - RNA, 20 nt, Artificial Sequence
  CIITA targeting sequence
aaugguucaggugguaaguc

SEQ ID NO: 51903 - RNA, 20 nt, Artificial Sequence
  CIITA targeting sequence
ggugguaagucauaugugua

SEQ ID NO: 51904 - RNA, 20 nt, Artificial Sequence
  CIITA targeting sequence
uauguguauuuuauuacaau

SEQ ID NO: 51905 - RNA, 20 nt, Artificial Sequence
  CIITA targeting sequence
uaggcugggcgugguggcuc

SEQ ID NO: 51906 - RNA, 20 nt, Artificial Sequence
  CIITA targeting sequence
cgccuguaaucuuguugcau

SEQ ID NO: 51907 - RNA, 20 nt, Artificial Sequence
  CIITA targeting sequence
uguugcaugauccuuggggu

SEQ ID NO: 51908 - RNA, 20 nt, Artificial Sequence
  CIITA targeting sequence
ugcaacaagauuacaggcgu

SEQ ID NO: 51909 - RNA, 20 nt, Artificial Sequence
  CIITA targeting sequence
uuggggugcugcuuuuaugg

SEQ ID NO: 51910 - RNA, 20 nt, Artificial Sequence
  CIITA targeting sequence
ggccauaaaagcagcacccc

SEQ ID NO: 51911 - RNA, 20 nt, Artificial Sequence
  CIITA targeting sequence
guggcugguggcaucuuuug

SEQ ID NO: 51912 - RNA, 20 nt, Artificial Sequence
  CIITA targeting sequence
uuuggccaaguuuugcuugg

SEQ ID NO: 51913 - RNA, 20 nt, Artificial Sequence
  CIITA targeting sequence
gcccacucagccuggcaggc

SEQ ID NO: 51914 - RNA, 20 nt, Artificial Sequence
  CIITA targeting sequence
gccuggcaggcugugcucgg

SEQ ID NO: 51915 - RNA, 20 nt, Artificial Sequence
  CIITA targeting sequence
gcucacacuaccagccugga

SEQ ID NO: 51916 - RNA, 20 nt, Artificial Sequence
  CIITA targeting sequence
cacuaccagccuggauccca

SEQ ID NO: 51917 - RNA, 20 nt, Artificial Sequence
  CIITA targeting sequence
aggcugguagugugagccga

SEQ ID NO: 51918 - RNA, 20 nt, Artificial Sequence
  CIITA targeting sequence
cacccuugcuugggcaagcc

SEQ ID NO: 51919 - RNA, 20 nt, Artificial Sequence
  CIITA targeting sequence
cugugccacaccuggcuugc

SEQ ID NO: 51920 - RNA, 20 nt, Artificial Sequence
  CIITA targeting sequence
cacaccccucacugugccac

SEQ ID NO: 51921 - RNA, 20 nt, Artificial Sequence
  CIITA targeting sequence
ggccacugugcauagucagg

SEQ ID NO: 51922 - RNA, 20 nt, Artificial Sequence
  CIITA targeting sequence
ggcacacuggcugcuacaac

SEQ ID NO: 51923 - RNA, 20 nt, Artificial Sequence
  CIITA targeting sequence
cugccccguuguagcagcca

SEQ ID NO: 51924 - RNA, 20 nt, Artificial Sequence
  CIITA targeting sequence
cugcgaggcugcggcgggac

SEQ ID NO: 51925 - RNA, 20 nt, Artificial Sequence
  CIITA targeting sequence
gcgaggcugcggcgggacca

SEQ ID NO: 51926 - RNA, 20 nt, Artificial Sequence
  CIITA targeting sequence
cagagagcuggcgccugugc

SEQ ID NO: 51927 - RNA, 20 nt, Artificial Sequence
  CIITA targeting sequence
cgccgcagccucgcagagag

SEQ ID NO: 51928 - RNA, 20 nt, Artificial Sequence
  CIITA targeting sequence
acggcugccacuggggaaug

SEQ ID NO: 51929 - RNA, 20 nt, Artificial Sequence
  CIITA targeting sequence
ccaguggcagccguggaggc

SEQ ID NO: 51930 - RNA, 20 nt, Artificial Sequence
  CIITA targeting sequence
aggcaccaaugcauucccca

SEQ ID NO: 51931 - RNA, 20 nt, Artificial Sequence
  CIITA targeting sequence
aggcuuccaggcaccaaugc

SEQ ID NO: 51932 - RNA, 20 nt, Artificial Sequence
  CIITA targeting sequence
aggaaccacagggccccaaa

SEQ ID NO: 51933 - RNA, 20 nt, Artificial Sequence
  CIITA targeting sequence
uggagccuccaggcuuccag

SEQ ID NO: 51934 - RNA, 20 nt, Artificial Sequence
  CIITA targeting sequence
uuggggcccugugguuccug

SEQ ID NO: 51935 - RNA, 20 nt, Artificial Sequence
  CIITA targeting sequence
cucuuuggggcccugugguu

SEQ ID NO: 51936 - RNA, 20 nt, Artificial Sequence
  CIITA targeting sequence
caguccugacuugggcuccc

SEQ ID NO: 51937 - RNA, 20 nt, Artificial Sequence
  CIITA targeting sequence
ugacuugggcucccaggucu

SEQ ID NO: 51938 - RNA, 20 nt, Artificial Sequence
  CIITA targeting sequence
ggacugggacucccucuuug

SEQ ID NO: 51939 - RNA, 20 nt, Artificial Sequence
  CIITA targeting sequence
caggucugggcucccugaag

SEQ ID NO: 51940 - RNA, 20 nt, Artificial Sequence
  CIITA targeting sequence
gggcucccugaagggccaca

SEQ ID NO: 51941 - RNA, 20 nt, Artificial Sequence
  CIITA targeting sequence
cugaagggccacagcucuuc

SEQ ID NO: 51942 - RNA, 20 nt, Artificial Sequence
  CIITA targeting sequence
gggagcccagaccugggagc

SEQ ID NO: 51943 - RNA, 20 nt, Artificial Sequence
  CIITA targeting sequence
ucucuccuucucuucaccca

SEQ ID NO: 51944 - RNA, 20 nt, Artificial Sequence
  CIITA targeting sequence
cuccuucucuucacccacaa

SEQ ID NO: 51945 - RNA, 20 nt, Artificial Sequence
  CIITA targeting sequence
ccuucucuucacccacaaua

SEQ ID NO: 51946 - RNA, 20 nt, Artificial Sequence
  CIITA targeting sequence
uucucuucacccacaauaug

SEQ ID NO: 51947 - RNA, 20 nt, Artificial Sequence
  CIITA targeting sequence
cuucacccacaauauggcaa

SEQ ID NO: 51948 - RNA, 20 nt, Artificial Sequence
  CIITA targeting sequence
ucacccacaauauggcaagc

SEQ ID NO: 51949 - RNA, 20 nt, Artificial Sequence
  CIITA targeting sequence
cccacaauauggcaagcaac

SEQ ID NO: 51950 - RNA, 20 nt, Artificial Sequence
  CIITA targeting sequence
gcccuguuuguguuacaguu

SEQ ID NO: 51951 - RNA, 20 nt, Artificial Sequence
  CIITA targeting sequence
uucagcccugccauucggca

SEQ ID NO: 51952 - RNA, 20 nt, Artificial Sequence
  CIITA targeting sequence
gcccugccauucggcaguuc

SEQ ID NO: 51953 - RNA, 20 nt, Artificial Sequence
  CIITA targeting sequence
gcaguucccgaguucuuguc

SEQ ID NO: 51954 - RNA, 20 nt, Artificial Sequence
  CIITA targeting sequence
cgaguucuugucuugcuucc

SEQ ID NO: 51955 - RNA, 20 nt, Artificial Sequence
  CIITA targeting sequence
ggaacugccgaauggcaggg

SEQ ID NO: 51956 - RNA, 20 nt, Artificial Sequence
  CIITA targeting sequence
ugucuugcuuccaagaagaa

SEQ ID NO: 51957 - RNA, 20 nt, Artificial Sequence
  CIITA targeting sequence
ugcuuccaagaagaaugagg

SEQ ID NO: 51958 - RNA, 20 nt, Artificial Sequence
  CIITA targeting sequence
aagaagaaugagguacgcag

SEQ ID NO: 51959 - RNA, 20 nt, Artificial Sequence
  CIITA targeting sequence
uggaagcaagacaagaacuc

SEQ ID NO: 51960 - RNA, 20 nt, Artificial Sequence
  CIITA targeting sequence
ucuuggaagcaagacaagaa

SEQ ID NO: 51961 - RNA, 20 nt, Artificial Sequence
  CIITA targeting sequence
uucuucuuggaagcaagaca

SEQ ID NO: 51962 - RNA, 20 nt, Artificial Sequence
  CIITA targeting sequence
gcguaccucauucuucuugg

SEQ ID NO: 51963 - RNA, 20 nt, Artificial Sequence
  CIITA targeting sequence
cccuacgcuugucugcguac

SEQ ID NO: 51964 - RNA, 20 nt, Artificial Sequence
  CIITA targeting sequence
ccuuguucgcccuacgcuug

SEQ ID NO: 51965 - RNA, 20 nt, Artificial Sequence
  CIITA targeting sequence
ucaccuuguucgcccuacgc

SEQ ID NO: 51966 - RNA, 20 nt, Artificial Sequence
  CIITA targeting sequence
ucaucaccuuguucgcccua

SEQ ID NO: 51967 - RNA, 20 nt, Artificial Sequence
  CIITA targeting sequence
auaaagcucuucaucaccuu

SEQ ID NO: 51968 - RNA, 20 nt, Artificial Sequence
  CIITA targeting sequence
cucaauaaagcucuucauca

SEQ ID NO: 51969 - RNA, 20 nt, Artificial Sequence
  CIITA targeting sequence
gucacucaauaaagcucuuc

SEQ ID NO: 51970 - RNA, 20 nt, Artificial Sequence
  CIITA targeting sequence
gaggaggccuuggagugggu

SEQ ID NO: 51971 - RNA, 20 nt, Artificial Sequence
  CIITA targeting sequence
gagcuauucugucacucaau

SEQ ID NO: 51972 - RNA, 20 nt, Artificial Sequence
  CIITA targeting sequence
ucugagcuauucugucacuc

SEQ ID NO: 51973 - RNA, 20 nt, Artificial Sequence
  CIITA targeting sequence
aaggccuccucugagcuauu

SEQ ID NO: 51974 - RNA, 20 nt, Artificial Sequence
  CIITA targeting sequence
cugcagcugguugaccugac

SEQ ID NO: 51975 - RNA, 20 nt, Artificial Sequence
  CIITA targeting sequence
gcagcugguugaccugacgu

SEQ ID NO: 51976 - RNA, 20 nt, Artificial Sequence
  CIITA targeting sequence
accagcugcagagagcagcu

SEQ ID NO: 51977 - RNA, 20 nt, Artificial Sequence
  CIITA targeting sequence
ggucaaccagcugcagagag

SEQ ID NO: 51978 - RNA, 20 nt, Artificial Sequence
  CIITA targeting sequence
gcucagcucuggcugagucc

SEQ ID NO: 51979 - RNA, 20 nt, Artificial Sequence
  CIITA targeting sequence
gcucuggcugaguccggugc

SEQ ID NO: 51980 - RNA, 20 nt, Artificial Sequence
  CIITA targeting sequence
ggcugaguccggugcuuuua

SEQ ID NO: 51981 - RNA, 20 nt, Artificial Sequence
  CIITA targeting sequence
gccagagcugagcagacguc

SEQ ID NO: 51982 - RNA, 20 nt, Artificial Sequence
  CIITA targeting sequence
ggugcuuuuaugggucucag

SEQ ID NO: 51983 - RNA, 20 nt, Artificial Sequence
  CIITA targeting sequence
cagagaagaggaaaugcaug

SEQ ID NO: 51984 - RNA, 20 nt, Artificial Sequence
  CIITA targeting sequence
gagaagaggaaaugcaugcc

SEQ ID NO: 51985 - RNA, 20 nt, Artificial Sequence
  CIITA targeting sequence
gagacccauaaaagcaccgg

SEQ ID NO: 51986 - RNA, 20 nt, Artificial Sequence
  CIITA targeting sequence
cugagacccauaaaagcacc

SEQ ID NO: 51987 - RNA, 20 nt, Artificial Sequence
  CIITA targeting sequence
ucucugagacccauaaaagc

SEQ ID NO: 51988 - RNA, 20 nt, Artificial Sequence
  CIITA targeting sequence
ucuucucugagacccauaaa

SEQ ID NO: 51989 - RNA, 20 nt, Artificial Sequence
  CIITA targeting sequence
auggguggccgugagugggc

SEQ ID NO: 51990 - RNA, 20 nt, Artificial Sequence
  CIITA targeting sequence
cggccacccauggaccguuu

SEQ ID NO: 51991 - RNA, 20 nt, Artificial Sequence
  CIITA targeting sequence
gggcccacucacggccaccc

SEQ ID NO: 51992 - RNA, 20 nt, Artificial Sequence
  CIITA targeting sequence
cacucugguccugugggacu

SEQ ID NO: 51993 - RNA, 20 nt, Artificial Sequence
  CIITA targeting sequence
gguccugugggacuggcagc

SEQ ID NO: 51994 - RNA, 20 nt, Artificial Sequence
  CIITA targeting sequence
ugugggacuggcagccuggc

SEQ ID NO: 51995 - RNA, 20 nt, Artificial Sequence
  CIITA targeting sequence
cacaggaccagagugggaac

SEQ ID NO: 51996 - RNA, 20 nt, Artificial Sequence
  CIITA targeting sequence
gacccucccugggugaaggu

SEQ ID NO: 51997 - RNA, 20 nt, Artificial Sequence
  CIITA targeting sequence
gaaggcugugggccaggcug

SEQ ID NO: 51998 - RNA, 20 nt, Artificial Sequence
  CIITA targeting sequence
cugggugaagguggggccuc

SEQ ID NO: 51999 - RNA, 20 nt, Artificial Sequence
  CIITA targeting sequence
cccagggaggguccgaaggc

SEQ ID NO: 52000 - RNA, 20 nt, Artificial Sequence
  CIITA targeting sequence
ccggggacccagcgccugca

SEQ ID NO: 52001 - RNA, 20 nt, Artificial Sequence
  CIITA targeting sequence
ccggugaggccccaccuuca

SEQ ID NO: 52002 - RNA, 20 nt, Artificial Sequence
  CIITA targeting sequence
uuggugcaggcgcugggucc

SEQ ID NO: 52003 - RNA, 20 nt, Artificial Sequence
  CIITA targeting sequence
gccucuugcugccguucaug

SEQ ID NO: 52004 - RNA, 20 nt, Artificial Sequence
  CIITA targeting sequence
ugcugccguucaugggccca

SEQ ID NO: 52005 - RNA, 20 nt, Artificial Sequence
  CIITA targeting sequence
ugggcccaggcuguaggugc

SEQ ID NO: 52006 - RNA, 20 nt, Artificial Sequence
  CIITA targeting sequence
gcaccaagcugcccucagcu

SEQ ID NO: 52007 - RNA, 20 nt, Artificial Sequence
  CIITA targeting sequence
gcuccccuucaacuucccuu

SEQ ID NO: 52008 - RNA, 20 nt, Artificial Sequence
  CIITA targeting sequence
ccuucaacuucccuucuaug

SEQ ID NO: 52009 - RNA, 20 nt, Artificial Sequence
  CIITA targeting sequence
acuucccuucuaugcuuguc

SEQ ID NO: 52010 - RNA, 20 nt, Artificial Sequence
  CIITA targeting sequence
cuucuaugcuugucagugcu

SEQ ID NO: 52011 - RNA, 20 nt, Artificial Sequence
  CIITA targeting sequence
augcuugucagugcucaaag

SEQ ID NO: 52012 - RNA, 20 nt, Artificial Sequence
  CIITA targeting sequence
gugcucaaaguccagagggg

SEQ ID NO: 52013 - RNA, 20 nt, Artificial Sequence
  CIITA targeting sequence
aaguccagagggggcugagg

SEQ ID NO: 52014 - RNA, 20 nt, Artificial Sequence
  CIITA targeting sequence
agagggggcugaggcagcag

SEQ ID NO: 52015 - RNA, 20 nt, Artificial Sequence
  CIITA targeting sequence
ggacuuugagcacugacaag

SEQ ID NO: 52016 - RNA, 20 nt, Artificial Sequence
  CIITA targeting sequence
gcccccucuggacuuugagc

SEQ ID NO: 52017 - RNA, 20 nt, Artificial Sequence
  CIITA targeting sequence
ccugcugccucagcccccuc

SEQ ID NO: 52018 - RNA, 20 nt, Artificial Sequence
  CIITA targeting sequence
gcacugccccggguguucac

SEQ ID NO: 52019 - RNA, 20 nt, Artificial Sequence
  CIITA targeting sequence
caccuggccgggcuuugcuu

SEQ ID NO: 52020 - RNA, 20 nt, Artificial Sequence
  CIITA targeting sequence
aagaucagagugggcaccga

SEQ ID NO: 52021 - RNA, 20 nt, Artificial Sequence
  CIITA targeting sequence
uggagcaaagcaaagcccgg

SEQ ID NO: 52022 - RNA, 20 nt, Artificial Sequence
  CIITA targeting sequence
gagugggcaccgacagcagg

SEQ ID NO: 52023 - RNA, 20 nt, Artificial Sequence
  CIITA targeting sequence
gaucuuggagcaaagcaaag

SEQ ID NO: 52024 - RNA, 20 nt, Artificial Sequence
  CIITA targeting sequence
gugcccacucugaucuugga

SEQ ID NO: 52025 - RNA, 20 nt, Artificial Sequence
  CIITA targeting sequence
cugcugucggugcccacucu

SEQ ID NO: 52026 - RNA, 20 nt, Artificial Sequence
  CIITA targeting sequence
cccugcugucggugcccacu

SEQ ID NO: 52027 - RNA, 20 nt, Artificial Sequence
  CIITA targeting sequence
cacugccuggcuucucccug

SEQ ID NO: 52028 - RNA, 20 nt, Artificial Sequence
  CIITA targeting sequence
gagccugugaggggaggggg

SEQ ID NO: 52029 - RNA, 20 nt, Artificial Sequence
  CIITA targeting sequence
gaagugccugcucccacugc

SEQ ID NO: 52030 - RNA, 20 nt, Artificial Sequence
  CIITA targeting sequence
caggcucagaagugccugcu

SEQ ID NO: 52031 - RNA, 20 nt, Artificial Sequence
  CIITA targeting sequence
ccucacaggcucagaagugc

SEQ ID NO: 52032 - RNA, 20 nt, Artificial Sequence
  CIITA targeting sequence
uccugggccaccaagagugc

SEQ ID NO: 52033 - RNA, 20 nt, Artificial Sequence
  CIITA targeting sequence
ugggccaccaagagugcagg

SEQ ID NO: 52034 - RNA, 20 nt, Artificial Sequence
  CIITA targeting sequence
ugguggcccaggaagacccc

SEQ ID NO: 52035 - RNA, 20 nt, Artificial Sequence
  CIITA targeting sequence
cugcacucuugguggcccag

SEQ ID NO: 52036 - RNA, 20 nt, Artificial Sequence
  CIITA targeting sequence
acagcugcaauuugggcagc

SEQ ID NO: 52037 - RNA, 20 nt, Artificial Sequence
  CIITA targeting sequence
agcacaccugcagcugccca

SEQ ID NO: 52038 - RNA, 20 nt, Artificial Sequence
  CIITA targeting sequence
ccagcacaccugcagcugcc

SEQ ID NO: 52039 - RNA, 20 nt, Artificial Sequence
  CIITA targeting sequence
cugucuccagcacaccugca

SEQ ID NO: 52040 - RNA, 20 nt, Artificial Sequence
  CIITA targeting sequence
gccugcucugugggguggga

SEQ ID NO: 52041 - RNA, 20 nt, Artificial Sequence
  CIITA targeting sequence
guggggugggaggccugaau

SEQ ID NO: 52042 - RNA, 20 nt, Artificial Sequence
  CIITA targeting sequence
caccccacagagcaggcaga

SEQ ID NO: 52043 - RNA, 20 nt, Artificial Sequence
  CIITA targeting sequence
ggccucccaccccacagagc

SEQ ID NO: 52044 - RNA, 20 nt, Artificial Sequence
  CIITA targeting sequence
gcagcugugguuuggguggc

SEQ ID NO: 52045 - RNA, 20 nt, Artificial Sequence
  CIITA targeting sequence
uggguacagcugcagccacc

SEQ ID NO: 52046 - RNA, 20 nt, Artificial Sequence
  CIITA targeting sequence
ugccugcuccauggagcggg

SEQ ID NO: 52047 - RNA, 20 nt, Artificial Sequence
  CIITA targeting sequence
auggagcgggacgcccaggu

SEQ ID NO: 52048 - RNA, 20 nt, Artificial Sequence
  CIITA targeting sequence
auggagcaggcaggagcccu

SEQ ID NO: 52049 - RNA, 20 nt, Artificial Sequence
  CIITA targeting sequence
cgcuccauggagcaggcagg

SEQ ID NO: 52050 - RNA, 20 nt, Artificial Sequence
  CIITA targeting sequence
gcaggcacgacuugggcagu

SEQ ID NO: 52051 - RNA, 20 nt, Artificial Sequence
  CIITA targeting sequence
ugccugcagaccugggcguc

SEQ ID NO: 52052 - RNA, 20 nt, Artificial Sequence
  CIITA targeting sequence
gggaagcucccaccccacua

SEQ ID NO: 52053 - RNA, 20 nt, Artificial Sequence
  CIITA targeting sequence
cggaugcagccacaacugcc

SEQ ID NO: 52054 - RNA, 20 nt, Artificial Sequence
  CIITA targeting sequence
caccccacuaacucaaaagg

SEQ ID NO: 52055 - RNA, 20 nt, Artificial Sequence
  CIITA targeting sequence
aaaggggcggggcucccacu

SEQ ID NO: 52056 - RNA, 20 nt, Artificial Sequence
  CIITA targeting sequence
cacuuguccccagcuccugc

SEQ ID NO: 52057 - RNA, 20 nt, Artificial Sequence
  CIITA targeting sequence
ccagcuccugccaccuccag

SEQ ID NO: 52058 - RNA, 20 nt, Artificial Sequence
  CIITA targeting sequence
ugccaccuccagagaaugug

SEQ ID NO: 52059 - RNA, 20 nt, Artificial Sequence
  CIITA targeting sequence
agagaaugugcagccccagc

SEQ ID NO: 52060 - RNA, 20 nt, Artificial Sequence
  CIITA targeting sequence
ggagguggcaggagcugggg

SEQ ID NO: 52061 - RNA, 20 nt, Artificial Sequence
  CIITA targeting sequence
cuggagguggcaggagcugg

SEQ ID NO: 52062 - RNA, 20 nt, Artificial Sequence
  CIITA targeting sequence
uugcugcagcuggagugacg

SEQ ID NO: 52063 - RNA, 20 nt, Artificial Sequence
  CIITA targeting sequence
agcugcagcaaggaggcaug

SEQ ID NO: 52064 - RNA, 20 nt, Artificial Sequence
  CIITA targeting sequence
cuccagcugcagcaaggagg

SEQ ID NO: 52065 - RNA, 20 nt, Artificial Sequence
  CIITA targeting sequence
gccgucacuccagcugcagc

SEQ ID NO: 52066 - RNA, 20 nt, Artificial Sequence
  CIITA targeting sequence
acaugggccaccgcugccau

SEQ ID NO: 52067 - RNA, 20 nt, Artificial Sequence
  CIITA targeting sequence
auccuagcacuuugggaggc

SEQ ID NO: 52068 - RNA, 20 nt, Artificial Sequence
  CIITA targeting sequence
uagcacuuugggaggcugag

SEQ ID NO: 52069 - RNA, 20 nt, Artificial Sequence
  CIITA targeting sequence
caaagugcuaggauugaugg

SEQ ID NO: 52070 - RNA, 20 nt, Artificial Sequence
  CIITA targeting sequence
gccucccaaagugcuaggau

SEQ ID NO: 52071 - RNA, 20 nt, Artificial Sequence
  CIITA targeting sequence
ugccucagccucccaaagug

SEQ ID NO: 52072 - RNA, 20 nt, Artificial Sequence
  CIITA targeting sequence
ccugccucagccucccaaag

SEQ ID NO: 52073 - RNA, 20 nt, Artificial Sequence
  CIITA targeting sequence
agcaauucuccugccucagc

SEQ ID NO: 52074 - RNA, 20 nt, Artificial Sequence
  CIITA targeting sequence
ugggcucaagcaauucuccu

SEQ ID NO: 52075 - RNA, 20 nt, Artificial Sequence
  CIITA targeting sequence
agaccagccugggcaacaga

SEQ ID NO: 52076 - RNA, 20 nt, Artificial Sequence
  CIITA targeting sequence
ugaacuccugggcucaagca

SEQ ID NO: 52077 - RNA, 20 nt, Artificial Sequence
  CIITA targeting sequence
guugcccaggcuggucuuga

SEQ ID NO: 52078 - RNA, 20 nt, Artificial Sequence
  CIITA targeting sequence
ggcucuguugcccaggcugg

SEQ ID NO: 52079 - RNA, 20 nt, Artificial Sequence
  CIITA targeting sequence
cuacaaaaaauaaaaaacua

SEQ ID NO: 52080 - RNA, 20 nt, Artificial Sequence
  CIITA targeting sequence
acaaaaaauaaaaaacuagc

SEQ ID NO: 52081 - RNA, 20 nt, Artificial Sequence
  CIITA targeting sequence
caucuauucaggaggcugag

SEQ ID NO: 52082 - RNA, 20 nt, Artificial Sequence
  CIITA targeting sequence
auucaggaggcugagguggg

SEQ ID NO: 52083 - RNA, 20 nt, Artificial Sequence
  CIITA targeting sequence
ggaggcugaggugggaggau

SEQ ID NO: 52084 - RNA, 20 nt, Artificial Sequence
  CIITA targeting sequence
ugaauagaugggaccacagg

SEQ ID NO: 52085 - RNA, 20 nt, Artificial Sequence
  CIITA targeting sequence
gccuccugaauagaugggac

SEQ ID NO: 52086 - RNA, 20 nt, Artificial Sequence
  CIITA targeting sequence
caccucagccuccugaauag

SEQ ID NO: 52087 - RNA, 20 nt, Artificial Sequence
  CIITA targeting sequence
ucccaccucagccuccugaa

SEQ ID NO: 52088 - RNA, 20 nt, Artificial Sequence
  CIITA targeting sequence
cuugaacccaggaguuugag

SEQ ID NO: 52089 - RNA, 20 nt, Artificial Sequence
  CIITA targeting sequence
agggauccucccaccucagc

SEQ ID NO: 52090 - RNA, 20 nt, Artificial Sequence
  CIITA targeting sequence
uggguucaagggauccuccc

SEQ ID NO: 52091 - RNA, 20 nt, Artificial Sequence
  CIITA targeting sequence
aacuccuggguucaagggau

SEQ ID NO: 52092 - RNA, 20 nt, Artificial Sequence
  CIITA targeting sequence
cuguagccucaaacuccugg

SEQ ID NO: 52093 - RNA, 20 nt, Artificial Sequence
  CIITA targeting sequence
acuccagccucugcucucca

SEQ ID NO: 52094 - RNA, 20 nt, Artificial Sequence
  CIITA targeting sequence
agccucugcucuccagccug

SEQ ID NO: 52095 - RNA, 20 nt, Artificial Sequence
  CIITA targeting sequence
gcucuccagccugggcaaca

SEQ ID NO: 52096 - RNA, 20 nt, Artificial Sequence
  CIITA targeting sequence
ccagccugggcaacagagcc

SEQ ID NO: 52097 - RNA, 20 nt, Artificial Sequence
  CIITA targeting sequence
agccugggcaacagagccag

SEQ ID NO: 52098 - RNA, 20 nt, Artificial Sequence
  CIITA targeting sequence
guugcccaggcuggagagca

SEQ ID NO: 52099 - RNA, 20 nt, Artificial Sequence
  CIITA targeting sequence
ggcucuguugcccaggcugg

SEQ ID NO: 52100 - RNA, 20 nt, Artificial Sequence
  CIITA targeting sequence
cuaaaaaauacaaaaauaaa

SEQ ID NO: 52101 - RNA, 20 nt, Artificial Sequence
  CIITA targeting sequence
aaaaaauacaaaaauaaaau

SEQ ID NO: 52102 - RNA, 20 nt, Artificial Sequence
  CIITA targeting sequence
uuauuuuauuuuuguauuuu

SEQ ID NO: 52103 - RNA, 20 nt, Artificial Sequence
  CIITA targeting sequence
gccaauaauuuuaaaaacuu

SEQ ID NO: 52104 - RNA, 20 nt, Artificial Sequence
  CIITA targeting sequence
ugccuguaaucccagcacuu

SEQ ID NO: 52105 - RNA, 20 nt, Artificial Sequence
  CIITA targeting sequence
cagcacuuugagagaccgag

SEQ ID NO: 52106 - RNA, 20 nt, Artificial Sequence
  CIITA targeting sequence
aagugcugggauuacaggca

SEQ ID NO: 52107 - RNA, 20 nt, Artificial Sequence
  CIITA targeting sequence
caaagugcugggauuacagg

SEQ ID NO: 52108 - RNA, 20 nt, Artificial Sequence
  CIITA targeting sequence
cucaaagugcugggauuaca

SEQ ID NO: 52109 - RNA, 20 nt, Artificial Sequence
  CIITA targeting sequence
gucucucaaagugcugggau

SEQ ID NO: 52110 - RNA, 20 nt, Artificial Sequence
  CIITA targeting sequence
gccugccucggucucucaaa

SEQ ID NO: 52111 - RNA, 20 nt, Artificial Sequence
  CIITA targeting sequence
cucgaggucaggaguucgag

SEQ ID NO: 52112 - RNA, 20 nt, Artificial Sequence
  CIITA targeting sequence
aggucaggaguucgagacca

SEQ ID NO: 52113 - RNA, 20 nt, Artificial Sequence
  CIITA targeting sequence
agugaucugccugccucggu

SEQ ID NO: 52114 - RNA, 20 nt, Artificial Sequence
  CIITA targeting sequence
ggaguucgagaccagccugg

SEQ ID NO: 52115 - RNA, 20 nt, Artificial Sequence
  CIITA targeting sequence
ugaccucgagugaucugccu

SEQ ID NO: 52116 - RNA, 20 nt, Artificial Sequence
  CIITA targeting sequence
agaccagccuggcuaacaug

SEQ ID NO: 52117 - RNA, 20 nt, Artificial Sequence
  CIITA targeting sequence
aacuccugaccucgagugau

SEQ ID NO: 52118 - RNA, 20 nt, Artificial Sequence
  CIITA targeting sequence
cgaacuccugaccucgagug

SEQ ID NO: 52119 - RNA, 20 nt, Artificial Sequence
  CIITA targeting sequence
ccauguuagccaggcugguc

SEQ ID NO: 52120 - RNA, 20 nt, Artificial Sequence
  CIITA targeting sequence
cuacuaaaaauacaaaaauu

SEQ ID NO: 52121 - RNA, 20 nt, Artificial Sequence
  CIITA targeting sequence
acuaaaaauacaaaaauuag

SEQ ID NO: 52122 - RNA, 20 nt, Artificial Sequence
  CIITA targeting sequence
cagcaacucgggaggcugag

SEQ ID NO: 52123 - RNA, 20 nt, Artificial Sequence
  CIITA targeting sequence
ggaggcugaggcaggagaau

SEQ ID NO: 52124 - RNA, 20 nt, Artificial Sequence
  CIITA targeting sequence
cgaguugcugggauuacagg

SEQ ID NO: 52125 - RNA, 20 nt, Artificial Sequence
  CIITA targeting sequence
gccucccgaguugcugggau

SEQ ID NO: 52126 - RNA, 20 nt, Artificial Sequence
  CIITA targeting sequence
ugccucagccucccgaguug

SEQ ID NO: 52127 - RNA, 20 nt, Artificial Sequence
  CIITA targeting sequence
ccugccucagccucccgagu

SEQ ID NO: 52128 - RNA, 20 nt, Artificial Sequence
  CIITA targeting sequence
cuugaacccgggggguggag

SEQ ID NO: 52129 - RNA, 20 nt, Artificial Sequence
  CIITA targeting sequence
agugauucuccugccucagc

SEQ ID NO: 52130 - RNA, 20 nt, Artificial Sequence
  CIITA targeting sequence
accccccggguucaagugau

SEQ ID NO: 52131 - RNA, 20 nt, Artificial Sequence
  CIITA targeting sequence
ccaccccccggguucaagug

SEQ ID NO: 52132 - RNA, 20 nt, Artificial Sequence
  CIITA targeting sequence
cugcaaucuccaccccccgg

SEQ ID NO: 52133 - RNA, 20 nt, Artificial Sequence
  CIITA targeting sequence
gcucacugcaaucuccaccc

SEQ ID NO: 52134 - RNA, 20 nt, Artificial Sequence
  CIITA targeting sequence
agcuuaggcaacagagugac

SEQ ID NO: 52135 - RNA, 20 nt, Artificial Sequence
  CIITA targeting sequence
guugccuaagcuggagugca

SEQ ID NO: 52136 - RNA, 20 nt, Artificial Sequence
  CIITA targeting sequence
cucuguugccuaagcuggag

SEQ ID NO: 52137 - RNA, 20 nt, Artificial Sequence
  CIITA targeting sequence
uaaaaaaaaaaauuauuaug

SEQ ID NO: 52138 - RNA, 20 nt, Artificial Sequence
  CIITA targeting sequence
acaaaucuuccaaggaauug

SEQ ID NO: 52139 - RNA, 20 nt, Artificial Sequence
  CIITA targeting sequence
uccaaggaauuguacaugag

SEQ ID NO: 52140 - RNA, 20 nt, Artificial Sequence
  CIITA targeting sequence
aaggaauuguacaugaguac

SEQ ID NO: 52141 - RNA, 20 nt, Artificial Sequence
  CIITA targeting sequence
uuggaagauuuguggaccuu

SEQ ID NO: 52142 - RNA, 20 nt, Artificial Sequence
  CIITA targeting sequence
uguacaauuccuuggaagau

SEQ ID NO: 52143 - RNA, 20 nt, Artificial Sequence
  CIITA targeting sequence
uguggugaccacccagacug

SEQ ID NO: 52144 - RNA, 20 nt, Artificial Sequence
  CIITA targeting sequence
ccacacgaguguguacucau

SEQ ID NO: 52145 - RNA, 20 nt, Artificial Sequence
  CIITA targeting sequence
ggguggucaccacacgagug

SEQ ID NO: 52146 - RNA, 20 nt, Artificial Sequence
  CIITA targeting sequence
gucuggguggucaccacacg

SEQ ID NO: 52147 - RNA, 20 nt, Artificial Sequence
  CIITA targeting sequence
cagucuggguggucaccaca

SEQ ID NO: 52148 - RNA, 20 nt, Artificial Sequence
  CIITA targeting sequence
aucucagucuggguggucac

SEQ ID NO: 52149 - RNA, 20 nt, Artificial Sequence
  CIITA targeting sequence
cuaucucagucugggugguc

SEQ ID NO: 52150 - RNA, 20 nt, Artificial Sequence
  CIITA targeting sequence
ugccuauucagucccucucu

SEQ ID NO: 52151 - RNA, 20 nt, Artificial Sequence
  CIITA targeting sequence
gucccucucuucccuccccc

SEQ ID NO: 52152 - RNA, 20 nt, Artificial Sequence
  CIITA targeting sequence
cucucuucccuccccccagc

SEQ ID NO: 52153 - RNA, 20 nt, Artificial Sequence
  CIITA targeting sequence
cuucccuccccccagcuccc

SEQ ID NO: 52154 - RNA, 20 nt, Artificial Sequence
  CIITA targeting sequence
ucccuccccccagcucccug

SEQ ID NO: 52155 - RNA, 20 nt, Artificial Sequence
  CIITA targeting sequence
cuccccccagcucccugggg

SEQ ID NO: 52156 - RNA, 20 nt, Artificial Sequence
  CIITA targeting sequence
ccccagcucccuggggauca

SEQ ID NO: 52157 - RNA, 20 nt, Artificial Sequence
  CIITA targeting sequence
cuggggaucagacuguauca

SEQ ID NO: 52158 - RNA, 20 nt, Artificial Sequence
  CIITA targeting sequence
ccagggagcuggggggaggg

SEQ ID NO: 52159 - RNA, 20 nt, Artificial Sequence
  CIITA targeting sequence
gacuguaucaccagagucug

SEQ ID NO: 52160 - RNA, 20 nt, Artificial Sequence
  CIITA targeting sequence
gauccccagggagcuggggg

SEQ ID NO: 52161 - RNA, 20 nt, Artificial Sequence
  CIITA targeting sequence
ccagagucuguuucugugac

SEQ ID NO: 52162 - RNA, 20 nt, Artificial Sequence
  CIITA targeting sequence
ggugauacagucugaucccc

SEQ ID NO: 52163 - RNA, 20 nt, Artificial Sequence
  CIITA targeting sequence
guuucugugaccaaacgucc

SEQ ID NO: 52164 - RNA, 20 nt, Artificial Sequence
  CIITA targeting sequence
gugaccaaacguccuauaaa

SEQ ID NO: 52165 - RNA, 20 nt, Artificial Sequence
  CIITA targeting sequence
cagaaacagacucuggugau

SEQ ID NO: 52166 - RNA, 20 nt, Artificial Sequence
  CIITA targeting sequence
uauaaacagaaucacguggu

SEQ ID NO: 52167 - RNA, 20 nt, Artificial Sequence
  CIITA targeting sequence
guuuauaggacguuugguca

SEQ ID NO: 52168 - RNA, 20 nt, Artificial Sequence
  CIITA targeting sequence
cgugguguaugcuucucugu

SEQ ID NO: 52169 - RNA, 20 nt, Artificial Sequence
  CIITA targeting sequence
cugugccuggcuuccuccuc

SEQ ID NO: 52170 - RNA, 20 nt, Artificial Sequence
  CIITA targeting sequence
gugccuggcuuccuccucug

SEQ ID NO: 52171 - RNA, 20 nt, Artificial Sequence
  CIITA targeting sequence
uccucugaacaugaugucca

SEQ ID NO: 52172 - RNA, 20 nt, Artificial Sequence
  CIITA targeting sequence
ucugaacaugauguccaggu

SEQ ID NO: 52173 - RNA, 20 nt, Artificial Sequence
  CIITA targeting sequence
gaacaugauguccaggugcu

SEQ ID NO: 52174 - RNA, 20 nt, Artificial Sequence
  CIITA targeting sequence
gaggaggaagccaggcacag

SEQ ID NO: 52175 - RNA, 20 nt, Artificial Sequence
  CIITA targeting sequence
uguucagaggaggaagccag

SEQ ID NO: 52176 - RNA, 20 nt, Artificial Sequence
  CIITA targeting sequence
aggugcuucaccuuguugau

SEQ ID NO: 52177 - RNA, 20 nt, Artificial Sequence
  CIITA targeting sequence
ccuuguugaugugugcaguu

SEQ ID NO: 52178 - RNA, 20 nt, Artificial Sequence
  CIITA targeting sequence
acaaggugaagcaccuggac

SEQ ID NO: 52179 - RNA, 20 nt, Artificial Sequence
  CIITA targeting sequence
uuguuuuguuuucugagacu

SEQ ID NO: 52180 - RNA, 20 nt, Artificial Sequence
  CIITA targeting sequence
gagacugguuuucauucugu

SEQ ID NO: 52181 - RNA, 20 nt, Artificial Sequence
  CIITA targeting sequence
gaaaacaaaacaaagaaaca

SEQ ID NO: 52182 - RNA, 20 nt, Artificial Sequence
  CIITA targeting sequence
cagaaaacaaaacaaagaaa

SEQ ID NO: 52183 - RNA, 20 nt, Artificial Sequence
  CIITA targeting sequence
uucuguugcccaggcuggag

SEQ ID NO: 52184 - RNA, 20 nt, Artificial Sequence
  CIITA targeting sequence
guugcccaggcuggaguacg

SEQ ID NO: 52185 - RNA, 20 nt, Artificial Sequence
  CIITA targeting sequence
agccugggcaacagaaugaa

SEQ ID NO: 52186 - RNA, 20 nt, Artificial Sequence
  CIITA targeting sequence
caccaccguacuccagccug

SEQ ID NO: 52187 - RNA, 20 nt, Artificial Sequence
  CIITA targeting sequence
uagcgcccugcagccuugac

SEQ ID NO: 52188 - RNA, 20 nt, Artificial Sequence
  CIITA targeting sequence
aggcugcagggcgcuaugau

SEQ ID NO: 52189 - RNA, 20 nt, Artificial Sequence
  CIITA targeting sequence
ugggcucaagugauccugca

SEQ ID NO: 52190 - RNA, 20 nt, Artificial Sequence
  CIITA targeting sequence
agugauccugcacgucagcc

SEQ ID NO: 52191 - RNA, 20 nt, Artificial Sequence
  CIITA targeting sequence
cuugagcccaggaggucaag

SEQ ID NO: 52192 - RNA, 20 nt, Artificial Sequence
  CIITA targeting sequence
ugcacgucagccuuuccagu

SEQ ID NO: 52193 - RNA, 20 nt, Artificial Sequence
  CIITA targeting sequence
gccuuuccaguugcugggac

SEQ ID NO: 52194 - RNA, 20 nt, Artificial Sequence
  CIITA targeting sequence
aguugcugggacuacagaca

SEQ ID NO: 52195 - RNA, 20 nt, Artificial Sequence
  CIITA targeting sequence
cagcaacuggaaaggcugac

SEQ ID NO: 52196 - RNA, 20 nt, Artificial Sequence
  CIITA targeting sequence
guagucccagcaacuggaaa

SEQ ID NO: 52197 - RNA, 20 nt, Artificial Sequence
  CIITA targeting sequence
gccagugugguggccugugu

SEQ ID NO: 52198 - RNA, 20 nt, Artificial Sequence
  CIITA targeting sequence
uuuucuagagaugugguuuc

SEQ ID NO: 52199 - RNA, 20 nt, Artificial Sequence
  CIITA targeting sequence
agagaugugguuucaccaug

SEQ ID NO: 52200 - RNA, 20 nt, Artificial Sequence
  CIITA targeting sequence
agaaaaagauacaaaaauca

SEQ ID NO: 52201 - RNA, 20 nt, Artificial Sequence
  CIITA targeting sequence
cuagaaaaagauacaaaaau

SEQ ID NO: 52202 - RNA, 20 nt, Artificial Sequence
  CIITA targeting sequence
ccauguugcccagguugguc

SEQ ID NO: 52203 - RNA, 20 nt, Artificial Sequence
  CIITA targeting sequence
ugaacuccugggcucaagug

SEQ ID NO: 52204 - RNA, 20 nt, Artificial Sequence
  CIITA targeting sequence
agaccaaccugggcaacaug

SEQ ID NO: 52205 - RNA, 20 nt, Artificial Sequence
  CIITA targeting sequence
ugggcucaagugcuccaccc

SEQ ID NO: 52206 - RNA, 20 nt, Artificial Sequence
  CIITA targeting sequence
agugcuccacccaccuuggc

SEQ ID NO: 52207 - RNA, 20 nt, Artificial Sequence
  CIITA targeting sequence
acccaccuuggccucccaaa

SEQ ID NO: 52208 - RNA, 20 nt, Artificial Sequence
  CIITA targeting sequence
caaagugcugggauuacaag

SEQ ID NO: 52209 - RNA, 20 nt, Artificial Sequence
  CIITA targeting sequence
cagcacuuugggaggccaag

SEQ ID NO: 52210 - RNA, 20 nt, Artificial Sequence
  CIITA targeting sequence
aacuuguaaucccagcacuu

SEQ ID NO: 52211 - RNA, 20 nt, Artificial Sequence
  CIITA targeting sequence
guggcucaaacuuguaaucc

SEQ ID NO: 52212 - RNA, 20 nt, Artificial Sequence
  CIITA targeting sequence
gccuguuaugugcaguugua

SEQ ID NO: 52213 - RNA, 20 nt, Artificial Sequence
  CIITA targeting sequence
auuccuucucacugcugugu

SEQ ID NO: 52214 - RNA, 20 nt, Artificial Sequence
  CIITA targeting sequence
uucucacugcuguguaauau

SEQ ID NO: 52215 - RNA, 20 nt, Artificial Sequence
  CIITA targeting sequence
cacugcuguguaauauucca

SEQ ID NO: 52216 - RNA, 20 nt, Artificial Sequence
  CIITA targeting sequence
cugcuguguaauauuccacu

SEQ ID NO: 52217 - RNA, 20 nt, Artificial Sequence
  CIITA targeting sequence
acugucugaauagaccauag

SEQ ID NO: 52218 - RNA, 20 nt, Artificial Sequence
  CIITA targeting sequence
gaauagaccauagguuuauc

SEQ ID NO: 52219 - RNA, 20 nt, Artificial Sequence
  CIITA targeting sequence
gacaguggaauauuacacag

SEQ ID NO: 52220 - RNA, 20 nt, Artificial Sequence
  CIITA targeting sequence
auucagacaguggaauauua

SEQ ID NO: 52221 - RNA, 20 nt, Artificial Sequence
  CIITA targeting sequence
gaccugaugucaacaagcuc

SEQ ID NO: 52222 - RNA, 20 nt, Artificial Sequence
  CIITA targeting sequence
gauaaaccuauggucuauuc

SEQ ID NO: 52223 - RNA, 20 nt, Artificial Sequence
  CIITA targeting sequence
ggucagauaaaccuaugguc

SEQ ID NO: 52224 - RNA, 20 nt, Artificial Sequence
  CIITA targeting sequence
acaagcucugcuguucccag

SEQ ID NO: 52225 - RNA, 20 nt, Artificial Sequence
  CIITA targeting sequence
gcuguucccaguuuggagcu

SEQ ID NO: 52226 - RNA, 20 nt, Artificial Sequence
  CIITA targeting sequence
caguuuggagcugucaugaa

SEQ ID NO: 52227 - RNA, 20 nt, Artificial Sequence
  CIITA targeting sequence
aaacugggaacagcagagcu

SEQ ID NO: 52228 - RNA, 20 nt, Artificial Sequence
  CIITA targeting sequence
ugaauagcgcugaugugugu

SEQ ID NO: 52229 - RNA, 20 nt, Artificial Sequence
  CIITA targeting sequence
ugacagcuccaaacugggaa

SEQ ID NO: 52230 - RNA, 20 nt, Artificial Sequence
  CIITA targeting sequence
gcgcuauucaugacagcucc

SEQ ID NO: 52231 - RNA, 20 nt, Artificial Sequence
  CIITA targeting sequence
agcacacacacaucagcgcu

SEQ ID NO: 52232 - RNA, 20 nt, Artificial Sequence
  CIITA targeting sequence
uuuggagaacguaccaccac

SEQ ID NO: 52233 - RNA, 20 nt, Artificial Sequence
  CIITA targeting sequence
aaaagacacguucaagcaca

SEQ ID NO: 52234 - RNA, 20 nt, Artificial Sequence
  CIITA targeting sequence
ccaaaagacacguucaagca

SEQ ID NO: 52235 - RNA, 20 nt, Artificial Sequence
  CIITA targeting sequence
guuggacauauccuuggaag

SEQ ID NO: 52236 - RNA, 20 nt, Artificial Sequence
  CIITA targeting sequence
aacagaaauguggugguacg

SEQ ID NO: 52237 - RNA, 20 nt, Artificial Sequence
  CIITA targeting sequence
uuggaagugggauugugggg

SEQ ID NO: 52238 - RNA, 20 nt, Artificial Sequence
  CIITA targeting sequence
aaggauauguccaacagaaa

SEQ ID NO: 52239 - RNA, 20 nt, Artificial Sequence
  CIITA targeting sequence
cacuuccaaggauaugucca

SEQ ID NO: 52240 - RNA, 20 nt, Artificial Sequence
  CIITA targeting sequence
uaggcuguguaugugcccag

SEQ ID NO: 52241 - RNA, 20 nt, Artificial Sequence
  CIITA targeting sequence
ggaaaucuguggcaagcaga

SEQ ID NO: 52242 - RNA, 20 nt, Artificial Sequence
  CIITA targeting sequence
cgaggcugggcacauacaca

SEQ ID NO: 52243 - RNA, 20 nt, Artificial Sequence
  CIITA targeting sequence
guggcaagcagauuucugaa

SEQ ID NO: 52244 - RNA, 20 nt, Artificial Sequence
  CIITA targeting sequence
gcuugccacagauuucccga

SEQ ID NO: 52245 - RNA, 20 nt, Artificial Sequence
  CIITA targeting sequence
gaaacauugcaccaacuuac

SEQ ID NO: 52246 - RNA, 20 nt, Artificial Sequence
  CIITA targeting sequence
gaaaucugcuugccacagau

SEQ ID NO: 52247 - RNA, 20 nt, Artificial Sequence
  CIITA targeting sequence
cagcagcagugagugggggu

SEQ ID NO: 52248 - RNA, 20 nt, Artificial Sequence
  CIITA targeting sequence
cugcugcugugaacguaagu

SEQ ID NO: 52249 - RNA, 20 nt, Artificial Sequence
  CIITA targeting sequence
aguugcuccccauccucacc

SEQ ID NO: 52250 - RNA, 20 nt, Artificial Sequence
  CIITA targeting sequence
ccauccucaccacucuuggu

SEQ ID NO: 52251 - RNA, 20 nt, Artificial Sequence
  CIITA targeting sequence
ucaccacucuugguuuugcc

SEQ ID NO: 52252 - RNA, 20 nt, Artificial Sequence
  CIITA targeting sequence
ccacucuugguuuugccauu

SEQ ID NO: 52253 - RNA, 20 nt, Artificial Sequence
  CIITA targeting sequence
ugguuuugccauuuucacuu

SEQ ID NO: 52254 - RNA, 20 nt, Artificial Sequence
  CIITA targeting sequence
cuuugcaccuucuggugggu

SEQ ID NO: 52255 - RNA, 20 nt, Artificial Sequence
  CIITA targeting sequence
gguggguguguugugugugg

SEQ ID NO: 52256 - RNA, 20 nt, Artificial Sequence
  CIITA targeting sequence
uuauuucaaagugaucaagg

SEQ ID NO: 52257 - RNA, 20 nt, Artificial Sequence
  CIITA targeting sequence
aagugaucaagguuagggcu

SEQ ID NO: 52258 - RNA, 20 nt, Artificial Sequence
  CIITA targeting sequence
cuuugaaauaaggagcugcc

SEQ ID NO: 52259 - RNA, 20 nt, Artificial Sequence
  CIITA targeting sequence
agguuagggcucacugguga

SEQ ID NO: 52260 - RNA, 20 nt, Artificial Sequence
  CIITA targeting sequence
cuggugagcccaggccacag

SEQ ID NO: 52261 - RNA, 20 nt, Artificial Sequence
  CIITA targeting sequence
ccagugagcccuaaccuuga

SEQ ID NO: 52262 - RNA, 20 nt, Artificial Sequence
  CIITA targeting sequence
gggauauguguggguaucau

SEQ ID NO: 52263 - RNA, 20 nt, Artificial Sequence
  CIITA targeting sequence
cagagccuguggccugggcu

SEQ ID NO: 52264 - RNA, 20 nt, Artificial Sequence
  CIITA targeting sequence
ugagaccuuccgugaagaau

SEQ ID NO: 52265 - RNA, 20 nt, Artificial Sequence
  CIITA targeting sequence
ugauacccacacauauccca

SEQ ID NO: 52266 - RNA, 20 nt, Artificial Sequence
  CIITA targeting sequence
caugauacccacacauaucc

SEQ ID NO: 52267 - RNA, 20 nt, Artificial Sequence
  CIITA targeting sequence
gugaagaaucucugguugga

SEQ ID NO: 52268 - RNA, 20 nt, Artificial Sequence
  CIITA targeting sequence
cggaaggucucaugauaccc

SEQ ID NO: 52269 - RNA, 20 nt, Artificial Sequence
  CIITA targeting sequence
ucacggaaggucucaugaua

SEQ ID NO: 52270 - RNA, 20 nt, Artificial Sequence
  CIITA targeting sequence
cugguuggagggccuugaag

SEQ ID NO: 52271 - RNA, 20 nt, Artificial Sequence
  CIITA targeting sequence
gguuggagggccuugaagac

SEQ ID NO: 52272 - RNA, 20 nt, Artificial Sequence
  CIITA targeting sequence
aaccagagauucuucacgga

SEQ ID NO: 52273 - RNA, 20 nt, Artificial Sequence
  CIITA targeting sequence
aggcccuccaaccagagauu

SEQ ID NO: 52274 - RNA, 20 nt, Artificial Sequence
  CIITA targeting sequence
ucaaggcccuccaaccagag

SEQ ID NO: 52275 - RNA, 20 nt, Artificial Sequence
  CIITA targeting sequence
uguccaguaaaggcuccuau

SEQ ID NO: 52276 - RNA, 20 nt, Artificial Sequence
  CIITA targeting sequence
aguaaaggcuccuauggaac

SEQ ID NO: 52277 - RNA, 20 nt, Artificial Sequence
  CIITA targeting sequence
uauggaacguauagaauuac

SEQ ID NO: 52278 - RNA, 20 nt, Artificial Sequence
  CIITA targeting sequence
auaggagccuuuacuggaca

SEQ ID NO: 52279 - RNA, 20 nt, Artificial Sequence
  CIITA targeting sequence
auacguuccauaggagccuu

SEQ ID NO: 52280 - RNA, 20 nt, Artificial Sequence
  CIITA targeting sequence
aacaagcgccggguaauucu

SEQ ID NO: 52281 - RNA, 20 nt, Artificial Sequence
  CIITA targeting sequence
gcauuucuaacaagcgccgg

SEQ ID NO: 52282 - RNA, 20 nt, Artificial Sequence
  CIITA targeting sequence
uggcugggcacgguggccca

SEQ ID NO: 52283 - RNA, 20 nt, Artificial Sequence
  CIITA targeting sequence
cagcacuuugggaggacaag

SEQ ID NO: 52284 - RNA, 20 nt, Artificial Sequence
  CIITA targeting sequence
caaagugcugggauuacagg

SEQ ID NO: 52285 - RNA, 20 nt, Artificial Sequence
  CIITA targeting sequence
ucccaaagugcugggauuac

SEQ ID NO: 52286 - RNA, 20 nt, Artificial Sequence
  CIITA targeting sequence
ugccuuguccucccaaagug

SEQ ID NO: 52287 - RNA, 20 nt, Artificial Sequence
  CIITA targeting sequence
uccugccuuguccucccaaa

SEQ ID NO: 52288 - RNA, 20 nt, Artificial Sequence
  CIITA targeting sequence
cuggagcccagaaguucaag

SEQ ID NO: 52289 - RNA, 20 nt, Artificial Sequence
  CIITA targeting sequence
agggaucuuccugccuuguc

SEQ ID NO: 52290 - RNA, 20 nt, Artificial Sequence
  CIITA targeting sequence
gggcuccagggaucuuccug

SEQ ID NO: 52291 - RNA, 20 nt, Artificial Sequence
  CIITA targeting sequence
agaccagccugggcaacaug

SEQ ID NO: 52292 - RNA, 20 nt, Artificial Sequence
  CIITA targeting sequence
ugaacuucugggcuccaggg

SEQ ID NO: 52293 - RNA, 20 nt, Artificial Sequence
  CIITA targeting sequence
ccauguugcccaggcugguc

SEQ ID NO: 52294 - RNA, 20 nt, Artificial Sequence
  CIITA targeting sequence
guuucgccauguugcccagg

SEQ ID NO: 52295 - RNA, 20 nt, Artificial Sequence
  CIITA targeting sequence
guuucaguuucgccauguug

SEQ ID NO: 52296 - RNA, 20 nt, Artificial Sequence
  CIITA targeting sequence
cauagauaguuuuuuggaua

SEQ ID NO: 52297 - RNA, 20 nt, Artificial Sequence
  CIITA targeting sequence
augggacuauugggucaguu

SEQ ID NO: 52298 - RNA, 20 nt, Artificial Sequence
  CIITA targeting sequence
aaaaaacuaucuaugggacu

SEQ ID NO: 52299 - RNA, 20 nt, Artificial Sequence
  CIITA targeting sequence
uuguuuauccaaaaaacuau

SEQ ID NO: 52300 - RNA, 20 nt, Artificial Sequence
  CIITA targeting sequence
auuucuuuguuuauccaaaa

SEQ ID NO: 52301 - RNA, 20 nt, Artificial Sequence
  CIITA targeting sequence
ugucuuaaaacuugaagcuu

SEQ ID NO: 52302 - RNA, 20 nt, Artificial Sequence
  CIITA targeting sequence
uaaaacuugaagcuuuuauu

SEQ ID NO: 52303 - RNA, 20 nt, Artificial Sequence
  CIITA targeting sequence
aguuuuaagacaagaagggu

SEQ ID NO: 52304 - RNA, 20 nt, Artificial Sequence
  CIITA targeting sequence
cguaaacaaauaaaagcuuc

SEQ ID NO: 52305 - RNA, 20 nt, Artificial Sequence
  CIITA targeting sequence
auaucaggaaaggaccuuca

SEQ ID NO: 52306 - RNA, 20 nt, Artificial Sequence
  CIITA targeting sequence
ggaaaggaccuucaggccuc

SEQ ID NO: 52307 - RNA, 20 nt, Artificial Sequence
  CIITA targeting sequence
ugauauagaacucacguaaa

SEQ ID NO: 52308 - RNA, 20 nt, Artificial Sequence
  CIITA targeting sequence
uuuccugauauagaacucac

SEQ ID NO: 52309 - RNA, 20 nt, Artificial Sequence
  CIITA targeting sequence
ggccucucaaaaaaguauca

SEQ ID NO: 52310 - RNA, 20 nt, Artificial Sequence
  CIITA targeting sequence
caaaaaaguaucaaagaacu

SEQ ID NO: 52311 - RNA, 20 nt, Artificial Sequence
  CIITA targeting sequence
aaaaaguaucaaagaacuga

SEQ ID NO: 52312 - RNA, 20 nt, Artificial Sequence
  CIITA targeting sequence
aagaacugaaacuaaccacc

SEQ ID NO: 52313 - RNA, 20 nt, Artificial Sequence
  CIITA targeting sequence
uugauacuuuuuugagaggc

SEQ ID NO: 52314 - RNA, 20 nt, Artificial Sequence
  CIITA targeting sequence
guucuuugauacuuuuuuga

SEQ ID NO: 52315 - RNA, 20 nt, Artificial Sequence
  CIITA targeting sequence
agacaaugagauguggaggg

SEQ ID NO: 52316 - RNA, 20 nt, Artificial Sequence
  CIITA targeting sequence
ggauguggugguuaguuuca

SEQ ID NO: 52317 - RNA, 20 nt, Artificial Sequence
  CIITA targeting sequence
uugucuggauguggugguua

SEQ ID NO: 52318 - RNA, 20 nt, Artificial Sequence
  CIITA targeting sequence
cauugucuggaugugguggu

SEQ ID NO: 52319 - RNA, 20 nt, Artificial Sequence
  CIITA targeting sequence
acaucucauugucuggaugu

SEQ ID NO: 52320 - RNA, 20 nt, Artificial Sequence
  CIITA targeting sequence
cugccccuccacaucucauu

SEQ ID NO: 52321 - RNA, 20 nt, Artificial Sequence
  CIITA targeting sequence
uucaucacgauuguuuccuu

SEQ ID NO: 52322 - RNA, 20 nt, Artificial Sequence
  CIITA targeting sequence
ucacgauuguuuccuugccc

SEQ ID NO: 52323 - RNA, 20 nt, Artificial Sequence
  CIITA targeting sequence
cgauuguuuccuugccccuc

SEQ ID NO: 52324 - RNA, 20 nt, Artificial Sequence
  CIITA targeting sequence
ugaugaaugagggccccucc

SEQ ID NO: 52325 - RNA, 20 nt, Artificial Sequence
  CIITA targeting sequence
uugccccuccuaguuccugu

SEQ ID NO: 52326 - RNA, 20 nt, Artificial Sequence
  CIITA targeting sequence
uaguuccuguuuucuugcac

SEQ ID NO: 52327 - RNA, 20 nt, Artificial Sequence
  CIITA targeting sequence
uguuuucuugcacaucguua

SEQ ID NO: 52328 - RNA, 20 nt, Artificial Sequence
  CIITA targeting sequence
ugcacaucguuacauuucuu

SEQ ID NO: 52329 - RNA, 20 nt, Artificial Sequence
  CIITA targeting sequence
uuacauuucuuuccugcugu

SEQ ID NO: 52330 - RNA, 20 nt, Artificial Sequence
  CIITA targeting sequence
uuccugcuguauaaaccccu

SEQ ID NO: 52331 - RNA, 20 nt, Artificial Sequence
  CIITA targeting sequence
ugcuguauaaaccccuaguu

SEQ ID NO: 52332 - RNA, 20 nt, Artificial Sequence
  CIITA targeting sequence
gggagguggguuuguggcug

SEQ ID NO: 52333 - RNA, 20 nt, Artificial Sequence
  CIITA targeting sequence
cugaccaacuaaaacuaggg

SEQ ID NO: 52334 - RNA, 20 nt, Artificial Sequence
  CIITA targeting sequence
gccacaaacccaccucccug

SEQ ID NO: 52335 - RNA, 20 nt, Artificial Sequence
  CIITA targeting sequence
caucugcuuggcugccagca

SEQ ID NO: 52336 - RNA, 20 nt, Artificial Sequence
  CIITA targeting sequence
gcuuggcugccagcaccgga

SEQ ID NO: 52337 - RNA, 20 nt, Artificial Sequence
  CIITA targeting sequence
ggugcuggcagccaagcaga

SEQ ID NO: 52338 - RNA, 20 nt, Artificial Sequence
  CIITA targeting sequence
uccuuuccuugguaauacuc

SEQ ID NO: 52339 - RNA, 20 nt, Artificial Sequence
  CIITA targeting sequence
uuuccuugguaauacucguc

SEQ ID NO: 52340 - RNA, 20 nt, Artificial Sequence
  CIITA targeting sequence
uugguaauacucgucaucuc

SEQ ID NO: 52341 - RNA, 20 nt, Artificial Sequence
  CIITA targeting sequence
ucaucucagucauuggcuuu

SEQ ID NO: 52342 - RNA, 20 nt, Artificial Sequence
  CIITA targeting sequence
ucucagucauuggcuuucug

SEQ ID NO: 52343 - RNA, 20 nt, Artificial Sequence
  CIITA targeting sequence
cagucauuggcuuucugugu

SEQ ID NO: 52344 - RNA, 20 nt, Artificial Sequence
  CIITA targeting sequence
gucauuggcuuucugugugg

SEQ ID NO: 52345 - RNA, 20 nt, Artificial Sequence
  CIITA targeting sequence
uuggcuuucuguguggcgag

SEQ ID NO: 52346 - RNA, 20 nt, Artificial Sequence
  CIITA targeting sequence
guguggcgagcagcaggacc

SEQ ID NO: 52347 - RNA, 20 nt, Artificial Sequence
  CIITA targeting sequence
ccacacagaaagccaaugac

SEQ ID NO: 52348 - RNA, 20 nt, Artificial Sequence
  CIITA targeting sequence
ugcugcucgccacacagaaa

SEQ ID NO: 52349 - RNA, 20 nt, Artificial Sequence
  CIITA targeting sequence
gaaccucuggugucuuggua

SEQ ID NO: 52350 - RNA, 20 nt, Artificial Sequence
  CIITA targeting sequence
gacuagguccugcugcucgc

SEQ ID NO: 52351 - RNA, 20 nt, Artificial Sequence
  CIITA targeting sequence
ggugucuugguaacaaaacc

SEQ ID NO: 52352 - RNA, 20 nt, Artificial Sequence
  CIITA targeting sequence
ugguaacaaaacccaccucu

SEQ ID NO: 52353 - RNA, 20 nt, Artificial Sequence
  CIITA targeting sequence
acaaaaaaaaaaaaaaaaaa

SEQ ID NO: 52354 - RNA, 20 nt, Artificial Sequence
  CIITA targeting sequence
uggguuuuauauauauauau

SEQ ID NO: 52355 - RNA, 20 nt, Artificial Sequence
  CIITA targeting sequence
accuccuggguuuuauauau

SEQ ID NO: 52356 - RNA, 20 nt, Artificial Sequence
  CIITA targeting sequence
cuguaaccuccaccuccugg

SEQ ID NO: 52357 - RNA, 20 nt, Artificial Sequence
  CIITA targeting sequence
guucacuguaaccuccaccu

SEQ ID NO: 52358 - RNA, 20 nt, Artificial Sequence
  CIITA targeting sequence
caguucacuguaaccuccac

SEQ ID NO: 52359 - RNA, 20 nt, Artificial Sequence
  CIITA targeting sequence
auauauauauauauauauau

SEQ ID NO: 52360 - RNA, 20 nt, Artificial Sequence
  CIITA targeting sequence
cagcuacucuggaggcugag

SEQ ID NO: 52361 - RNA, 20 nt, Artificial Sequence
  CIITA targeting sequence
ggaggcugaggugggaggau

SEQ ID NO: 52362 - RNA, 20 nt, Artificial Sequence
  CIITA targeting sequence
agaguagcugggacuacagg

SEQ ID NO: 52363 - RNA, 20 nt, Artificial Sequence
  CIITA targeting sequence
gccuccagaguagcugggac

SEQ ID NO: 52364 - RNA, 20 nt, Artificial Sequence
  CIITA targeting sequence
caccucagccuccagaguag

SEQ ID NO: 52365 - RNA, 20 nt, Artificial Sequence
  CIITA targeting sequence
ucccaccucagccuccagag

SEQ ID NO: 52366 - RNA, 20 nt, Artificial Sequence
  CIITA targeting sequence
auccucccaccucagccucc

SEQ ID NO: 52367 - RNA, 20 nt, Artificial Sequence
  CIITA targeting sequence
auccauccucccaccucagc

SEQ ID NO: 52368 - RNA, 20 nt, Artificial Sequence
  CIITA targeting sequence
ugggcucaauccauccuccc

SEQ ID NO: 52369 - RNA, 20 nt, Artificial Sequence
  CIITA targeting sequence
aggcugcagugagucaugau

SEQ ID NO: 52370 - RNA, 20 nt, Artificial Sequence
  CIITA targeting sequence
cugcagccuugaacuccugg

SEQ ID NO: 52371 - RNA, 20 nt, Artificial Sequence
  CIITA targeting sequence
ugauugcgccacugcccucc

SEQ ID NO: 52372 - RNA, 20 nt, Artificial Sequence
  CIITA targeting sequence
ugacucacugcagccuugaa

SEQ ID NO: 52373 - RNA, 20 nt, Artificial Sequence
  CIITA targeting sequence
agccugggcaacagagcaag

SEQ ID NO: 52374 - RNA, 20 nt, Artificial Sequence
  CIITA targeting sequence
guugcccaggcuggagggca

SEQ ID NO: 52375 - RNA, 20 nt, Artificial Sequence
  CIITA targeting sequence
ugcucuguugcccaggcugg

SEQ ID NO: 52376 - RNA, 20 nt, Artificial Sequence
  CIITA targeting sequence
aaacaaaaacaaaaaccaaa

SEQ ID NO: 52377 - RNA, 20 nt, Artificial Sequence
  CIITA targeting sequence
gguuuuugguuuuuguuuuu

SEQ ID NO: 52378 - RNA, 20 nt, Artificial Sequence
  CIITA targeting sequence
guggcucaccucccacucac

SEQ ID NO: 52379 - RNA, 20 nt, Artificial Sequence
  CIITA targeting sequence
ccucccacucacagggucag

SEQ ID NO: 52380 - RNA, 20 nt, Artificial Sequence
  CIITA targeting sequence
cacucacagggucaggaacu

SEQ ID NO: 52381 - RNA, 20 nt, Artificial Sequence
  CIITA targeting sequence
cagggucaggaacucaagag

SEQ ID NO: 52382 - RNA, 20 nt, Artificial Sequence
  CIITA targeting sequence
ggaacucaagaggggcccag

SEQ ID NO: 52383 - RNA, 20 nt, Artificial Sequence
  CIITA targeting sequence
ugacccugugagugggaggu

SEQ ID NO: 52384 - RNA, 20 nt, Artificial Sequence
  CIITA targeting sequence
agaggggcccagcacgaggu

SEQ ID NO: 52385 - RNA, 20 nt, Artificial Sequence
  CIITA targeting sequence
ugaguuccugacccugugag

SEQ ID NO: 52386 - RNA, 20 nt, Artificial Sequence
  CIITA targeting sequence
ugcugggccccucuugaguu

SEQ ID NO: 52387 - RNA, 20 nt, Artificial Sequence
  CIITA targeting sequence
cagaccugccugugagagcc

SEQ ID NO: 52388 - RNA, 20 nt, Artificial Sequence
  CIITA targeting sequence
gugaaaauaccucgugcugg

SEQ ID NO: 52389 - RNA, 20 nt, Artificial Sequence
  CIITA targeting sequence
caggcaggucugugaaaaua

SEQ ID NO: 52390 - RNA, 20 nt, Artificial Sequence
  CIITA targeting sequence
cacaggcaggucugugaaaa

SEQ ID NO: 52391 - RNA, 20 nt, Artificial Sequence
  CIITA targeting sequence
gcccagagcucaguggugag

SEQ ID NO: 52392 - RNA, 20 nt, Artificial Sequence
  CIITA targeting sequence
gggcagaggcucucacaggc

SEQ ID NO: 52393 - RNA, 20 nt, Artificial Sequence
  CIITA targeting sequence
guggugaggacaagcgcucu

SEQ ID NO: 52394 - RNA, 20 nt, Artificial Sequence
  CIITA targeting sequence
ccacugagcucugggcagag

SEQ ID NO: 52395 - RNA, 20 nt, Artificial Sequence
  CIITA targeting sequence
ucaccacugagcucugggca

SEQ ID NO: 52396 - RNA, 20 nt, Artificial Sequence
  CIITA targeting sequence
gccuuuccauagcuccaugg

SEQ ID NO: 52397 - RNA, 20 nt, Artificial Sequence
  CIITA targeting sequence
auagcuccauggccuuggac

SEQ ID NO: 52398 - RNA, 20 nt, Artificial Sequence
  CIITA targeting sequence
auggccuuggacucagugcu

SEQ ID NO: 52399 - RNA, 20 nt, Artificial Sequence
  CIITA targeting sequence
aaggccauggagcuauggaa

SEQ ID NO: 52400 - RNA, 20 nt, Artificial Sequence
  CIITA targeting sequence
gugcuuacccugucuggccu

SEQ ID NO: 52401 - RNA, 20 nt, Artificial Sequence
  CIITA targeting sequence
ggccucaguuuucucguuug

SEQ ID NO: 52402 - RNA, 20 nt, Artificial Sequence
  CIITA targeting sequence
guuuucucguuuguaaaaug

SEQ ID NO: 52403 - RNA, 20 nt, Artificial Sequence
  CIITA targeting sequence
cguuuguaaaaugagcauaa

SEQ ID NO: 52404 - RNA, 20 nt, Artificial Sequence
  CIITA targeting sequence
uuuguaaaaugagcauaaua

SEQ ID NO: 52405 - RNA, 20 nt, Artificial Sequence
  CIITA targeting sequence
uuuuacaaacgagaaaacug

SEQ ID NO: 52406 - RNA, 20 nt, Artificial Sequence
  CIITA targeting sequence
uguuauuaugcucauuuuac

SEQ ID NO: 52407 - RNA, 20 nt, Artificial Sequence
  CIITA targeting sequence
uaggauguuuuggggauuaa

SEQ ID NO: 52408 - RNA, 20 nt, Artificial Sequence
  CIITA targeting sequence
uaugaaguggguccuguuau

SEQ ID NO: 52409 - RNA, 20 nt, Artificial Sequence
  CIITA targeting sequence
ccaaaacauccuaugaagug

SEQ ID NO: 52410 - RNA, 20 nt, Artificial Sequence
  CIITA targeting sequence
cuuuaauccccaaaacaucc

SEQ ID NO: 52411 - RNA, 20 nt, Artificial Sequence
  CIITA targeting sequence
uguuuguacuaugcuugaaa

SEQ ID NO: 52412 - RNA, 20 nt, Artificial Sequence
  CIITA targeting sequence
agcauaguacaaacaugagu

SEQ ID NO: 52413 - RNA, 20 nt, Artificial Sequence
  CIITA targeting sequence
uuggcaccuagcuagcacuc

SEQ ID NO: 52414 - RNA, 20 nt, Artificial Sequence
  CIITA targeting sequence
auaaauggccguaaaauuua

SEQ ID NO: 52415 - RNA, 20 nt, Artificial Sequence
  CIITA targeting sequence
cgccuguaaucccagcacuu

SEQ ID NO: 52416 - RNA, 20 nt, Artificial Sequence
  CIITA targeting sequence
cagcacuuugggaggccgug

SEQ ID NO: 52417 - RNA, 20 nt, Artificial Sequence
  CIITA targeting sequence
caaagugcugggauuacagg

SEQ ID NO: 52418 - RNA, 20 nt, Artificial Sequence
  CIITA targeting sequence
acccaccacggccucccaaa

SEQ ID NO: 52419 - RNA, 20 nt, Artificial Sequence
  CIITA targeting sequence
ccugaguucaggaguuugag

SEQ ID NO: 52420 - RNA, 20 nt, Artificial Sequence
  CIITA targeting sequence
ggugauccacccaccacggc

SEQ ID NO: 52421 - RNA, 20 nt, Artificial Sequence
  CIITA targeting sequence
ggaguuugagaccagcuugu

SEQ ID NO: 52422 - RNA, 20 nt, Artificial Sequence
  CIITA targeting sequence
ugaacucaggugauccaccc

SEQ ID NO: 52423 - RNA, 20 nt, Artificial Sequence
  CIITA targeting sequence
aacuccugaacucaggugau

SEQ ID NO: 52424 - RNA, 20 nt, Artificial Sequence
  CIITA targeting sequence
caaacuccugaacucaggug

SEQ ID NO: 52425 - RNA, 20 nt, Artificial Sequence
  CIITA targeting sequence
aacauggcaaaacccugucu

SEQ ID NO: 52426 - RNA, 20 nt, Artificial Sequence
  CIITA targeting sequence
cuacuaaaaauacaaaaauu

SEQ ID NO: 52427 - RNA, 20 nt, Artificial Sequence
  CIITA targeting sequence
acuaaaaauacaaaaauuag

SEQ ID NO: 52428 - RNA, 20 nt, Artificial Sequence
  CIITA targeting sequence
cagcuacuugagaggcugag

SEQ ID NO: 52429 - RNA, 20 nt, Artificial Sequence
  CIITA targeting sequence
aguagcugggauuacaggca

SEQ ID NO: 52430 - RNA, 20 nt, Artificial Sequence
  CIITA targeting sequence
caaguagcugggauuacagg

SEQ ID NO: 52431 - RNA, 20 nt, Artificial Sequence
  CIITA targeting sequence
gccucucaaguagcugggau

SEQ ID NO: 52432 - RNA, 20 nt, Artificial Sequence
  CIITA targeting sequence
ugccucagccucucaaguag

SEQ ID NO: 52433 - RNA, 20 nt, Artificial Sequence
  CIITA targeting sequence
cuugccucagccucucaagu

SEQ ID NO: 52434 - RNA, 20 nt, Artificial Sequence
  CIITA targeting sequence
cuugaacccaggaggcggag

SEQ ID NO: 52435 - RNA, 20 nt, Artificial Sequence
  CIITA targeting sequence
agugauucucuugccucagc

SEQ ID NO: 52436 - RNA, 20 nt, Artificial Sequence
  CIITA targeting sequence
uggguucaagugauucucuu

SEQ ID NO: 52437 - RNA, 20 nt, Artificial Sequence
  CIITA targeting sequence
gccuccuggguucaagugau

SEQ ID NO: 52438 - RNA, 20 nt, Artificial Sequence
  CIITA targeting sequence
uguaaccuccgccuccuggg

SEQ ID NO: 52439 - RNA, 20 nt, Artificial Sequence
  CIITA targeting sequence
gcucguguaaccuccgccuc

SEQ ID NO: 52440 - RNA, 20 nt, Artificial Sequence
  CIITA targeting sequence
cagcucguguaaccuccgcc

SEQ ID NO: 52441 - RNA, 20 nt, Artificial Sequence
  CIITA targeting sequence
agccugugcaacaggagcaa

SEQ ID NO: 52442 - RNA, 20 nt, Artificial Sequence
  CIITA targeting sequence
uguugcacaggcuggagugc

SEQ ID NO: 52443 - RNA, 20 nt, Artificial Sequence
  CIITA targeting sequence
aucucaaaaaaauaaauaaa

SEQ ID NO: 52444 - RNA, 20 nt, Artificial Sequence
  CIITA targeting sequence
caaaaaaauaaauaaauaaa

SEQ ID NO: 52445 - RNA, 20 nt, Artificial Sequence
  CIITA targeting sequence
aaaaaauaaauaaauaaagu

SEQ ID NO: 52446 - RNA, 20 nt, Artificial Sequence
  CIITA targeting sequence
cgcccaagggagguuggcac

SEQ ID NO: 52447 - RNA, 20 nt, Artificial Sequence
  CIITA targeting sequence
cccaagggagguuggcacua

SEQ ID NO: 52448 - RNA, 20 nt, Artificial Sequence
  CIITA targeting sequence
cuugggcgagacagggccua

SEQ ID NO: 52449 - RNA, 20 nt, Artificial Sequence
  CIITA targeting sequence
ugcuagugccaaccucccuu

SEQ ID NO: 52450 - RNA, 20 nt, Artificial Sequence
  CIITA targeting sequence
agucaugcuagugccaaccu

SEQ ID NO: 52451 - RNA, 20 nt, Artificial Sequence
  CIITA targeting sequence
gugccauauaacuguuguuc

SEQ ID NO: 52452 - RNA, 20 nt, Artificial Sequence
  CIITA targeting sequence
aguugggacacaggaaacuu

SEQ ID NO: 52453 - RNA, 20 nt, Artificial Sequence
  CIITA targeting sequence
caacuggaacaacaguuaua

SEQ ID NO: 52454 - RNA, 20 nt, Artificial Sequence
  CIITA targeting sequence
ugugucccaacuggaacaac

SEQ ID NO: 52455 - RNA, 20 nt, Artificial Sequence
  CIITA targeting sequence
aguccagagggcugggguuu

SEQ ID NO: 52456 - RNA, 20 nt, Artificial Sequence
  CIITA targeting sequence
agagggcugggguuuguggg

SEQ ID NO: 52457 - RNA, 20 nt, Artificial Sequence
  CIITA targeting sequence
ggacuugagcuuuacacugg

SEQ ID NO: 52458 - RNA, 20 nt, Artificial Sequence
  CIITA targeting sequence
cacaaaccccagcccucugg

SEQ ID NO: 52459 - RNA, 20 nt, Artificial Sequence
  CIITA targeting sequence
cccacaaaccccagcccucu

SEQ ID NO: 52460 - RNA, 20 nt, Artificial Sequence
  CIITA targeting sequence
gucucccacaaaccccagcc

SEQ ID NO: 52461 - RNA, 20 nt, Artificial Sequence
  CIITA targeting sequence
ccccaggacuaucagagaga

SEQ ID NO: 52462 - RNA, 20 nt, Artificial Sequence
  CIITA targeting sequence
uggggugacaguucugucuc

SEQ ID NO: 52463 - RNA, 20 nt, Artificial Sequence
  CIITA targeting sequence
gagagagaggggcuccuggc

SEQ ID NO: 52464 - RNA, 20 nt, Artificial Sequence
  CIITA targeting sequence
gauaguccuggggugacagu

SEQ ID NO: 52465 - RNA, 20 nt, Artificial Sequence
  CIITA targeting sequence
cugauaguccuggggugaca

SEQ ID NO: 52466 - RNA, 20 nt, Artificial Sequence
  CIITA targeting sequence
cucugauaguccugggguga

SEQ ID NO: 52467 - RNA, 20 nt, Artificial Sequence
  CIITA targeting sequence
cucucugauaguccuggggu

SEQ ID NO: 52468 - RNA, 20 nt, Artificial Sequence
  CIITA targeting sequence
uggcucuuauuucugcagaa

SEQ ID NO: 52469 - RNA, 20 nt, Artificial Sequence
  CIITA targeting sequence
uauuucugcagaagcagcua

SEQ ID NO: 52470 - RNA, 20 nt, Artificial Sequence
  CIITA targeting sequence
gcagaagcagcuagauggac

SEQ ID NO: 52471 - RNA, 20 nt, Artificial Sequence
  CIITA targeting sequence
gcagaaauaagagccaggag

SEQ ID NO: 52472 - RNA, 20 nt, Artificial Sequence
  CIITA targeting sequence
agcugcuucugcagaaauaa

SEQ ID NO: 52473 - RNA, 20 nt, Artificial Sequence
  CIITA targeting sequence
aucuagcugcuucugcagaa

SEQ ID NO: 52474 - RNA, 20 nt, Artificial Sequence
  CIITA targeting sequence
cucacuccaaggagccucca

SEQ ID NO: 52475 - RNA, 20 nt, Artificial Sequence
  CIITA targeting sequence
cuccaaggagccuccaccac

SEQ ID NO: 52476 - RNA, 20 nt, Artificial Sequence
  CIITA targeting sequence
aaggagccuccaccacgugc

SEQ ID NO: 52477 - RNA, 20 nt, Artificial Sequence
  CIITA targeting sequence
uuggagugagggaccugucc

SEQ ID NO: 52478 - RNA, 20 nt, Artificial Sequence
  CIITA targeting sequence
accacgugcccacaccuuuc

SEQ ID NO: 52479 - RNA, 20 nt, Artificial Sequence
  CIITA targeting sequence
cugguuucacuuucaguuuc

SEQ ID NO: 52480 - RNA, 20 nt, Artificial Sequence
  CIITA targeting sequence
gguuucacuuucaguuucuu

SEQ ID NO: 52481 - RNA, 20 nt, Artificial Sequence
  CIITA targeting sequence
cuuucaguuucuuggaaagg

SEQ ID NO: 52482 - RNA, 20 nt, Artificial Sequence
  CIITA targeting sequence
guuucuuggaaaggcugucc

SEQ ID NO: 52483 - RNA, 20 nt, Artificial Sequence
  CIITA targeting sequence
uggaaaggcuguccuucccu

SEQ ID NO: 52484 - RNA, 20 nt, Artificial Sequence
  CIITA targeting sequence
aagaaacugaaagugaaacc

SEQ ID NO: 52485 - RNA, 20 nt, Artificial Sequence
  CIITA targeting sequence
uucccuacuccaagccccuc

SEQ ID NO: 52486 - RNA, 20 nt, Artificial Sequence
  CIITA targeting sequence
cuacuccaagccccuccccu

SEQ ID NO: 52487 - RNA, 20 nt, Artificial Sequence
  CIITA targeting sequence
aagccccuccccucacuccc

SEQ ID NO: 52488 - RNA, 20 nt, Artificial Sequence
  CIITA targeting sequence
ccucacuccccacccaggau

SEQ ID NO: 52489 - RNA, 20 nt, Artificial Sequence
  CIITA targeting sequence
cuccccacccaggaucuggg

SEQ ID NO: 52490 - RNA, 20 nt, Artificial Sequence
  CIITA targeting sequence
ccacccaggaucugggcacu

SEQ ID NO: 52491 - RNA, 20 nt, Artificial Sequence
  CIITA targeting sequence
uggguggggagugaggggag

SEQ ID NO: 52492 - RNA, 20 nt, Artificial Sequence
  CIITA targeting sequence
gggcacuggaggcgccagac

SEQ ID NO: 52493 - RNA, 20 nt, Artificial Sequence
  CIITA targeting sequence
agugcccagauccugggugg

SEQ ID NO: 52494 - RNA, 20 nt, Artificial Sequence
  CIITA targeting sequence
ggcgccuccagugcccagau

SEQ ID NO: 52495 - RNA, 20 nt, Artificial Sequence
  CIITA targeting sequence
uaugcccuguccaaggcuag

SEQ ID NO: 52496 - RNA, 20 nt, Artificial Sequence
  CIITA targeting sequence
aaggcuagcagguaagaaac

SEQ ID NO: 52497 - RNA, 20 nt, Artificial Sequence
  CIITA targeting sequence
uaccugcuagccuuggacag

SEQ ID NO: 52498 - RNA, 20 nt, Artificial Sequence
  CIITA targeting sequence
gccaaggucaaaaucauaca

SEQ ID NO: 52499 - RNA, 20 nt, Artificial Sequence
  CIITA targeting sequence
aaaucauacacacccaggug

SEQ ID NO: 52500 - RNA, 20 nt, Artificial Sequence
  CIITA targeting sequence
uacacacccagguggggcag

SEQ ID NO: 52501 - RNA, 20 nt, Artificial Sequence
  CIITA targeting sequence
caccucugggaggugucuug

SEQ ID NO: 52502 - RNA, 20 nt, Artificial Sequence
  CIITA targeting sequence
gggaggugucuugcagaagc

SEQ ID NO: 52503 - RNA, 20 nt, Artificial Sequence
  CIITA targeting sequence
cagaggugggacugccccac

SEQ ID NO: 52504 - RNA, 20 nt, Artificial Sequence
  CIITA targeting sequence
ugcagaagcacuccuaggag

SEQ ID NO: 52505 - RNA, 20 nt, Artificial Sequence
  CIITA targeting sequence
gcaagacaccucccagaggu

SEQ ID NO: 52506 - RNA, 20 nt, Artificial Sequence
  CIITA targeting sequence
uaggagugugaggugauuug

SEQ ID NO: 52507 - RNA, 20 nt, Artificial Sequence
  CIITA targeting sequence
uaggagugcuucugcaagac

SEQ ID NO: 52508 - RNA, 20 nt, Artificial Sequence
  CIITA targeting sequence
cacuccuaggagugcuucug

SEQ ID NO: 52509 - RNA, 20 nt, Artificial Sequence
  CIITA targeting sequence
ccucacacuccuaggagugc

SEQ ID NO: 52510 - RNA, 20 nt, Artificial Sequence
  CIITA targeting sequence
acagugcuuguggucagaaa

SEQ ID NO: 52511 - RNA, 20 nt, Artificial Sequence
  CIITA targeting sequence
gaaacaacuggaaagaaguu

SEQ ID NO: 52512 - RNA, 20 nt, Artificial Sequence
  CIITA targeting sequence
gaccacaagcacuguggagc

SEQ ID NO: 52513 - RNA, 20 nt, Artificial Sequence
  CIITA targeting sequence
aguuguuucugaccacaagc

SEQ ID NO: 52514 - RNA, 20 nt, Artificial Sequence
  CIITA targeting sequence
uuccaguuguuucugaccac

SEQ ID NO: 52515 - RNA, 20 nt, Artificial Sequence
  CIITA targeting sequence
gcagcaugguggggugaggg

SEQ ID NO: 52516 - RNA, 20 nt, Artificial Sequence
  CIITA targeting sequence
ccccaccaugcugcugagca

SEQ ID NO: 52517 - RNA, 20 nt, Artificial Sequence
  CIITA targeting sequence
cacgccauaacccacgaggu

SEQ ID NO: 52518 - RNA, 20 nt, Artificial Sequence
  CIITA targeting sequence
uggguuauggcgugggaugc

SEQ ID NO: 52519 - RNA, 20 nt, Artificial Sequence
  CIITA targeting sequence
augggcugaugggggaucag

SEQ ID NO: 52520 - RNA, 20 nt, Artificial Sequence
  CIITA targeting sequence
gcccauagaggcuaccucgu

SEQ ID NO: 52521 - RNA, 20 nt, Artificial Sequence
  CIITA targeting sequence
cccaucagcccauagaggcu

SEQ ID NO: 52522 - RNA, 20 nt, Artificial Sequence
  CIITA targeting sequence
gugcagggugguaagggcca

SEQ ID NO: 52523 - RNA, 20 nt, Artificial Sequence
  CIITA targeting sequence
gaagggagagugggcuccca

SEQ ID NO: 52524 - RNA, 20 nt, Artificial Sequence
  CIITA targeting sequence
gaccuggcccuggcccuuac

SEQ ID NO: 52525 - RNA, 20 nt, Artificial Sequence
  CIITA targeting sequence
cuucagaccuggcccuggcc

SEQ ID NO: 52526 - RNA, 20 nt, Artificial Sequence
  CIITA targeting sequence
cccuucagaccuggcccugg

SEQ ID NO: 52527 - RNA, 20 nt, Artificial Sequence
  CIITA targeting sequence
cauucaugugagugggaaaa

SEQ ID NO: 52528 - RNA, 20 nt, Artificial Sequence
  CIITA targeting sequence
ugugagugggaaaagcaaug

SEQ ID NO: 52529 - RNA, 20 nt, Artificial Sequence
  CIITA targeting sequence
caugaaugggagcccacucu

SEQ ID NO: 52530 - RNA, 20 nt, Artificial Sequence
  CIITA targeting sequence
cacucacaugaaugggagcc

SEQ ID NO: 52531 - RNA, 20 nt, Artificial Sequence
  CIITA targeting sequence
aggugcgccaggucgugcag

SEQ ID NO: 52532 - RNA, 20 nt, Artificial Sequence
  CIITA targeting sequence
ugcagagcauaucuugaaaa

SEQ ID NO: 52533 - RNA, 20 nt, Artificial Sequence
  CIITA targeting sequence
gcacgaccuggcgcaccugg

SEQ ID NO: 52534 - RNA, 20 nt, Artificial Sequence
  CIITA targeting sequence
ugaaaaggcacacaagggau

SEQ ID NO: 52535 - RNA, 20 nt, Artificial Sequence
  CIITA targeting sequence
agauaugcucugcacgaccu

SEQ ID NO: 52536 - RNA, 20 nt, Artificial Sequence
  CIITA targeting sequence
cuugugugccuuuucaagau

SEQ ID NO: 52537 - RNA, 20 nt, Artificial Sequence
  CIITA targeting sequence
aucccuugugugccuuuuca

SEQ ID NO: 52538 - RNA, 20 nt, Artificial Sequence
  CIITA targeting sequence
gagagguugccucaggcagg

SEQ ID NO: 52539 - RNA, 20 nt, Artificial Sequence
  CIITA targeting sequence
gaucaaucccuugugugccu

SEQ ID NO: 52540 - RNA, 20 nt, Artificial Sequence
  CIITA targeting sequence
cugaucaaucccuugugugc

SEQ ID NO: 52541 - RNA, 20 nt, Artificial Sequence
  CIITA targeting sequence
ggcaggauaacugagaucug

SEQ ID NO: 52542 - RNA, 20 nt, Artificial Sequence
  CIITA targeting sequence
ugccugaggcaaccucucug

SEQ ID NO: 52543 - RNA, 20 nt, Artificial Sequence
  CIITA targeting sequence
guuauccugccugaggcaac

SEQ ID NO: 52544 - RNA, 20 nt, Artificial Sequence
  CIITA targeting sequence
caguuauccugccugaggca

SEQ ID NO: 52545 - RNA, 20 nt, Artificial Sequence
  CIITA targeting sequence
ggaaauggugugggagggga

SEQ ID NO: 52546 - RNA, 20 nt, Artificial Sequence
  CIITA targeting sequence
agaucucaguuauccugccu

SEQ ID NO: 52547 - RNA, 20 nt, Artificial Sequence
  CIITA targeting sequence
cacaccauuuccagaucuca

SEQ ID NO: 52548 - RNA, 20 nt, Artificial Sequence
  CIITA targeting sequence
ccucccacaccauuuccaga

SEQ ID NO: 52549 - RNA, 20 nt, Artificial Sequence
  CIITA targeting sequence
gugaaguccuuggaugcuuu

SEQ ID NO: 52550 - RNA, 20 nt, Artificial Sequence
  CIITA targeting sequence
cagaaaaaaaacugguuccc

SEQ ID NO: 52551 - RNA, 20 nt, Artificial Sequence
  CIITA targeting sequence
uuggaugcuuugaauuuuug

SEQ ID NO: 52552 - RNA, 20 nt, Artificial Sequence
  CIITA targeting sequence
aaggacuucacagaaaaaaa

SEQ ID NO: 52553 - RNA, 20 nt, Artificial Sequence
  CIITA targeting sequence
aagcauccaaggacuucaca

SEQ ID NO: 52554 - RNA, 20 nt, Artificial Sequence
  CIITA targeting sequence
ugcgcaugcaugauuauugu

SEQ ID NO: 52555 - RNA, 20 nt, Artificial Sequence
  CIITA targeting sequence
ugcaugcgcaugacuuaaac

SEQ ID NO: 52556 - RNA, 20 nt, Artificial Sequence
  CIITA targeting sequence
cugcccccaccccaccucaa

SEQ ID NO: 52557 - RNA, 20 nt, Artificial Sequence
  CIITA targeting sequence
aguacagaagaaaagaaaga

SEQ ID NO: 52558 - RNA, 20 nt, Artificial Sequence
  CIITA targeting sequence
guacuugagguggggugggg

SEQ ID NO: 52559 - RNA, 20 nt, Artificial Sequence
  CIITA targeting sequence
ucuguacuugagguggggug

SEQ ID NO: 52560 - RNA, 20 nt, Artificial Sequence
  CIITA targeting sequence
uuucuucuguacuugaggug

SEQ ID NO: 52561 - RNA, 20 nt, Artificial Sequence
  CIITA targeting sequence
uucuuuucuucuguacuuga

SEQ ID NO: 52562 - RNA, 20 nt, Artificial Sequence
  CIITA targeting sequence
uucuuaaacuaguuugcugg

SEQ ID NO: 52563 - RNA, 20 nt, Artificial Sequence
  CIITA targeting sequence
uaaacuaguuugcuggaggg

SEQ ID NO: 52564 - RNA, 20 nt, Artificial Sequence
  CIITA targeting sequence
agcaaacuaguuuaagaaag

SEQ ID NO: 52565 - RNA, 20 nt, Artificial Sequence
  CIITA targeting sequence
agcccuccagcaaacuaguu

SEQ ID NO: 52566 - RNA, 20 nt, Artificial Sequence
  CIITA targeting sequence
uuuguugcucauuuucuggg

SEQ ID NO: 52567 - RNA, 20 nt, Artificial Sequence
  CIITA targeting sequence
uuuucugggagauguagguu

SEQ ID NO: 52568 - RNA, 20 nt, Artificial Sequence
  CIITA targeting sequence
gggagauguagguuaaaauu

SEQ ID NO: 52569 - RNA, 20 nt, Artificial Sequence
  CIITA targeting sequence
cagaaaaugagcaacaaagg

SEQ ID NO: 52570 - RNA, 20 nt, Artificial Sequence
  CIITA targeting sequence
cccagaaaaugagcaacaaa

SEQ ID NO: 52571 - RNA, 20 nt, Artificial Sequence
  CIITA targeting sequence
uuggagggcuuuggagucag

SEQ ID NO: 52572 - RNA, 20 nt, Artificial Sequence
  CIITA targeting sequence
aaagauguagguuaauuuua

SEQ ID NO: 52573 - RNA, 20 nt, Artificial Sequence
  CIITA targeting sequence
aaagcccuccaaagauguag

SEQ ID NO: 52574 - RNA, 20 nt, Artificial Sequence
  CIITA targeting sequence
gacugucuguguucaagucc

SEQ ID NO: 52575 - RNA, 20 nt, Artificial Sequence
  CIITA targeting sequence
gacuccaaagcccuccaaag

SEQ ID NO: 52576 - RNA, 20 nt, Artificial Sequence
  CIITA targeting sequence
guguucaaguccuggcugcc

SEQ ID NO: 52577 - RNA, 20 nt, Artificial Sequence
  CIITA targeting sequence
aguccuggcugccccacuuu

SEQ ID NO: 52578 - RNA, 20 nt, Artificial Sequence
  CIITA targeting sequence
uggcugccccacuuuguagc

SEQ ID NO: 52579 - RNA, 20 nt, Artificial Sequence
  CIITA targeting sequence
cgagcaagucgcuuaacuuc

SEQ ID NO: 52580 - RNA, 20 nt, Artificial Sequence
  CIITA targeting sequence
agcaagucgcuuaacuucuc

SEQ ID NO: 52581 - RNA, 20 nt, Artificial Sequence
  CIITA targeting sequence
agaagcuacaaaguggggca

SEQ ID NO: 52582 - RNA, 20 nt, Artificial Sequence
  CIITA targeting sequence
cuuaacuucucugagcuuuu

SEQ ID NO: 52583 - RNA, 20 nt, Artificial Sequence
  CIITA targeting sequence
cugagcuuuuauuuucucuc

SEQ ID NO: 52584 - RNA, 20 nt, Artificial Sequence
  CIITA targeting sequence
gagcuuuuauuuucucuccu

SEQ ID NO: 52585 - RNA, 20 nt, Artificial Sequence
  CIITA targeting sequence
gagaaguuaagcgacuugcu

SEQ ID NO: 52586 - RNA, 20 nt, Artificial Sequence
  CIITA targeting sequence
cuccuguaaaauggcacaau

SEQ ID NO: 52587 - RNA, 20 nt, Artificial Sequence
  CIITA targeting sequence
ccuguaaaauggcacaauau

SEQ ID NO: 52588 - RNA, 20 nt, Artificial Sequence
  CIITA targeting sequence
uguaaaauggcacaauauua

SEQ ID NO: 52589 - RNA, 20 nt, Artificial Sequence
  CIITA targeting sequence
auaauauugugccauuuuac

SEQ ID NO: 52590 - RNA, 20 nt, Artificial Sequence
  CIITA targeting sequence
acauuauaucaauaauauug

SEQ ID NO: 52591 - RNA, 20 nt, Artificial Sequence
  CIITA targeting sequence
auaauaaugucaacauuaua

SEQ ID NO: 52592 - RNA, 20 nt, Artificial Sequence
  CIITA targeting sequence
auguauccauaauaauguca

SEQ ID NO: 52593 - RNA, 20 nt, Artificial Sequence
  CIITA targeting sequence
aaaaaaaaaaaaucaaugua

SEQ ID NO: 52594 - RNA, 20 nt, Artificial Sequence
  CIITA targeting sequence
caaaaaaaaaaaaaucaaug

SEQ ID NO: 52595 - RNA, 20 nt, Artificial Sequence
  CIITA targeting sequence
aucucucacccagguuggag

SEQ ID NO: 52596 - RNA, 20 nt, Artificial Sequence
  CIITA targeting sequence
cucacccagguuggagugca

SEQ ID NO: 52597 - RNA, 20 nt, Artificial Sequence
  CIITA targeting sequence
cacccagguuggagugcagu

SEQ ID NO: 52598 - RNA, 20 nt, Artificial Sequence
  CIITA targeting sequence
cccagguuggagugcagugg

SEQ ID NO: 52599 - RNA, 20 nt, Artificial Sequence
  CIITA targeting sequence
aaccugggugagagauggag

SEQ ID NO: 52600 - RNA, 20 nt, Artificial Sequence
  CIITA targeting sequence
ugccacugcacuccaaccug

SEQ ID NO: 52601 - RNA, 20 nt, Artificial Sequence
  CIITA targeting sequence
aagcucacugcagccuugac

SEQ ID NO: 52602 - RNA, 20 nt, Artificial Sequence
  CIITA targeting sequence
cugcagccuugaccuucugg

SEQ ID NO: 52603 - RNA, 20 nt, Artificial Sequence
  CIITA targeting sequence
aggcugcagugagcuuugau

SEQ ID NO: 52604 - RNA, 20 nt, Artificial Sequence
  CIITA targeting sequence
ggacucaagugaucuuccca

SEQ ID NO: 52605 - RNA, 20 nt, Artificial Sequence
  CIITA targeting sequence
agaaggucaaggcugcagug

SEQ ID NO: 52606 - RNA, 20 nt, Artificial Sequence
  CIITA targeting sequence
agugaucuucccaccucagc

SEQ ID NO: 52607 - RNA, 20 nt, Artificial Sequence
  CIITA targeting sequence
cuugaguccagaaggucaag

SEQ ID NO: 52608 - RNA, 20 nt, Artificial Sequence
  CIITA targeting sequence
ucccaccucagccucuugaa

SEQ ID NO: 52609 - RNA, 20 nt, Artificial Sequence
  CIITA targeting sequence
caccucagccucuugaauag

SEQ ID NO: 52610 - RNA, 20 nt, Artificial Sequence
  CIITA targeting sequence
gccucuugaauagcugagac

SEQ ID NO: 52611 - RNA, 20 nt, Artificial Sequence
  CIITA targeting sequence
ugaauagcugagacuacagg

SEQ ID NO: 52612 - RNA, 20 nt, Artificial Sequence
  CIITA targeting sequence
agaggcugaggugggaagau

SEQ ID NO: 52613 - RNA, 20 nt, Artificial Sequence
  CIITA targeting sequence
gcuauucaagaggcugaggu

SEQ ID NO: 52614 - RNA, 20 nt, Artificial Sequence
  CIITA targeting sequence
cagcuauucaagaggcugag

SEQ ID NO: 52615 - RNA, 20 nt, Artificial Sequence
  CIITA targeting sequence
agcccagcuaauuuuuugua

SEQ ID NO: 52616 - RNA, 20 nt, Artificial Sequence
  CIITA targeting sequence
acaaaaaauuagcugggcuu

SEQ ID NO: 52617 - RNA, 20 nt, Artificial Sequence
  CIITA targeting sequence
cuacaaaaaauuagcugggc

SEQ ID NO: 52618 - RNA, 20 nt, Artificial Sequence
  CIITA targeting sequence
ugucucuacaaaaaauuagc

SEQ ID NO: 52619 - RNA, 20 nt, Artificial Sequence
  CIITA targeting sequence
ugcuuuguuggccaggcugg

SEQ ID NO: 52620 - RNA, 20 nt, Artificial Sequence
  CIITA targeting sequence
caaacuucugggcucaagca

SEQ ID NO: 52621 - RNA, 20 nt, Artificial Sequence
  CIITA targeting sequence
aacuucugggcucaagcaau

SEQ ID NO: 52622 - RNA, 20 nt, Artificial Sequence
  CIITA targeting sequence
gggcucaagcaaucuuccug

SEQ ID NO: 52623 - RNA, 20 nt, Artificial Sequence
  CIITA targeting sequence
agcaaucuuccugccugggc

SEQ ID NO: 52624 - RNA, 20 nt, Artificial Sequence
  CIITA targeting sequence
uccugccugggccccucaaa

SEQ ID NO: 52625 - RNA, 20 nt, Artificial Sequence
  CIITA targeting sequence
ugccugggccccucaaagug

SEQ ID NO: 52626 - RNA, 20 nt, Artificial Sequence
  CIITA targeting sequence
aaguguggggauuaccagca

SEQ ID NO: 52627 - RNA, 20 nt, Artificial Sequence
  CIITA targeting sequence
ccacacuuugaggggcccag

SEQ ID NO: 52628 - RNA, 20 nt, Artificial Sequence
  CIITA targeting sequence
ugcugguaauccccacacuu

SEQ ID NO: 52629 - RNA, 20 nt, Artificial Sequence
  CIITA targeting sequence
gggcggguuggcucaugcug

SEQ ID NO: 52630 - RNA, 20 nt, Artificial Sequence
  CIITA targeting sequence
guccgggcggguuggcucau

SEQ ID NO: 52631 - RNA, 20 nt, Artificial Sequence
  CIITA targeting sequence
caucaguccgggcggguugg

SEQ ID NO: 52632 - RNA, 20 nt, Artificial Sequence
  CIITA targeting sequence
acauauucacaucaguccgg

SEQ ID NO: 52633 - RNA, 20 nt, Artificial Sequence
  CIITA targeting sequence
cauuaauaucaacauauuca

SEQ ID NO: 52634 - RNA, 20 nt, Artificial Sequence
  CIITA targeting sequence
gccuuauaggcuuguugcgu

SEQ ID NO: 52635 - RNA, 20 nt, Artificial Sequence
  CIITA targeting sequence
augagacagugcagggacau

SEQ ID NO: 52636 - RNA, 20 nt, Artificial Sequence
  CIITA targeting sequence
uugaagccacgcaacaagcc

SEQ ID NO: 52637 - RNA, 20 nt, Artificial Sequence
  CIITA targeting sequence
cauugaagccacgcaacaag

SEQ ID NO: 52638 - RNA, 20 nt, Artificial Sequence
  CIITA targeting sequence
cugcacugucucauugaagc

SEQ ID NO: 52639 - RNA, 20 nt, Artificial Sequence
  CIITA targeting sequence
ggcaugucccugcacugucu

SEQ ID NO: 52640 - RNA, 20 nt, Artificial Sequence
  CIITA targeting sequence
caggcaugucccugcacugu

SEQ ID NO: 52641 - RNA, 20 nt, Artificial Sequence
  CIITA targeting sequence
ugugguggggggugccuggc

SEQ ID NO: 52642 - RNA, 20 nt, Artificial Sequence
  CIITA targeting sequence
ugcugucauguggugggggg

SEQ ID NO: 52643 - RNA, 20 nt, Artificial Sequence
  CIITA targeting sequence
gugucuacaguacacuucca

SEQ ID NO: 52644 - RNA, 20 nt, Artificial Sequence
  CIITA targeting sequence
acaguacacuuccacugcua

SEQ ID NO: 52645 - RNA, 20 nt, Artificial Sequence
  CIITA targeting sequence
acugcuaugggcggcggguu

SEQ ID NO: 52646 - RNA, 20 nt, Artificial Sequence
  CIITA targeting sequence
acccaacccgccgcccauag

SEQ ID NO: 52647 - RNA, 20 nt, Artificial Sequence
  CIITA targeting sequence
ccacccaacccgccgcccau

SEQ ID NO: 52648 - RNA, 20 nt, Artificial Sequence
  CIITA targeting sequence
ucaugccuauuugcagaugg

SEQ ID NO: 52649 - RNA, 20 nt, Artificial Sequence
  CIITA targeting sequence
ugccuauuugcagaugggua

SEQ ID NO: 52650 - RNA, 20 nt, Artificial Sequence
  CIITA targeting sequence
gcaaauaggcaugaagaucu

SEQ ID NO: 52651 - RNA, 20 nt, Artificial Sequence
  CIITA targeting sequence
accuacccaucugcaaauag

SEQ ID NO: 52652 - RNA, 20 nt, Artificial Sequence
  CIITA targeting sequence
caggguaagaggccuggucg

SEQ ID NO: 52653 - RNA, 20 nt, Artificial Sequence
  CIITA targeting sequence
uacccugggacuuugcuacu

SEQ ID NO: 52654 - RNA, 20 nt, Artificial Sequence
  CIITA targeting sequence
gggccgcuugugcccuggau

SEQ ID NO: 52655 - RNA, 20 nt, Artificial Sequence
  CIITA targeting sequence
agggcacaagcggccccgac

SEQ ID NO: 52656 - RNA, 20 nt, Artificial Sequence
  CIITA targeting sequence
auuagugaccugcuguggga

SEQ ID NO: 52657 - RNA, 20 nt, Artificial Sequence
  CIITA targeting sequence
cuaauagauccagggcacaa

SEQ ID NO: 52658 - RNA, 20 nt, Artificial Sequence
  CIITA targeting sequence
cacagcaggucacuaauaga

SEQ ID NO: 52659 - RNA, 20 nt, Artificial Sequence
  CIITA targeting sequence
caaggucccacagcagguca

SEQ ID NO: 52660 - RNA, 20 nt, Artificial Sequence
  CIITA targeting sequence
cuuccccuugucagugaauu

SEQ ID NO: 52661 - RNA, 20 nt, Artificial Sequence
  CIITA targeting sequence
ccuugucagugaauugaugg

SEQ ID NO: 52662 - RNA, 20 nt, Artificial Sequence
  CIITA targeting sequence
gugaauugaugggguuggaa

SEQ ID NO: 52663 - RNA, 20 nt, Artificial Sequence
  CIITA targeting sequence
cugacaaggggaagggacca

SEQ ID NO: 52664 - RNA, 20 nt, Artificial Sequence
  CIITA targeting sequence
auucacugacaaggggaagg

SEQ ID NO: 52665 - RNA, 20 nt, Artificial Sequence
  CIITA targeting sequence
aaccccaucaauucacugac

SEQ ID NO: 52666 - RNA, 20 nt, Artificial Sequence
  CIITA targeting sequence
ccugggaaucgugaaaugca

SEQ ID NO: 52667 - RNA, 20 nt, Artificial Sequence
  CIITA targeting sequence
ugggaaucgugaaaugcagg

SEQ ID NO: 52668 - RNA, 20 nt, Artificial Sequence
  CIITA targeting sequence
caggagagccuuuccaaccc

SEQ ID NO: 52669 - RNA, 20 nt, Artificial Sequence
  CIITA targeting sequence
ugaaaugcagggucuccaag

SEQ ID NO: 52670 - RNA, 20 nt, Artificial Sequence
  CIITA targeting sequence
cgauucccaggagagccuuu

SEQ ID NO: 52671 - RNA, 20 nt, Artificial Sequence
  CIITA targeting sequence
ccaagcacuagugacaagug

SEQ ID NO: 52672 - RNA, 20 nt, Artificial Sequence
  CIITA targeting sequence
aagcacuagugacaagugag

SEQ ID NO: 52673 - RNA, 20 nt, Artificial Sequence
  CIITA targeting sequence
cuagugcuuggagacccugc

SEQ ID NO: 52674 - RNA, 20 nt, Artificial Sequence
  CIITA targeting sequence
cuugucacuagugcuuggag

SEQ ID NO: 52675 - RNA, 20 nt, Artificial Sequence
  CIITA targeting sequence
gauccuguuccaggcccugg

SEQ ID NO: 52676 - RNA, 20 nt, Artificial Sequence
  CIITA targeting sequence
gaggugcugccaccucacuu

SEQ ID NO: 52677 - RNA, 20 nt, Artificial Sequence
  CIITA targeting sequence
uguuccaggcccuggggcua

SEQ ID NO: 52678 - RNA, 20 nt, Artificial Sequence
  CIITA targeting sequence
aggcccuggggcuaggcauc

SEQ ID NO: 52679 - RNA, 20 nt, Artificial Sequence
  CIITA targeting sequence
gcccucaggcuuaggagccu

SEQ ID NO: 52680 - RNA, 20 nt, Artificial Sequence
  CIITA targeting sequence
ggcuuaggagccuccgucug

SEQ ID NO: 52681 - RNA, 20 nt, Artificial Sequence
  CIITA targeting sequence
uaagccugagggcagaugcc

SEQ ID NO: 52682 - RNA, 20 nt, Artificial Sequence
  CIITA targeting sequence
gucuguguccucugccagca

SEQ ID NO: 52683 - RNA, 20 nt, Artificial Sequence
  CIITA targeting sequence
guguccucugccagcacacc

SEQ ID NO: 52684 - RNA, 20 nt, Artificial Sequence
  CIITA targeting sequence
ucugccagcacacccgcuuu

SEQ ID NO: 52685 - RNA, 20 nt, Artificial Sequence
  CIITA targeting sequence
gccagcacacccgcuuuacc

SEQ ID NO: 52686 - RNA, 20 nt, Artificial Sequence
  CIITA targeting sequence
ugugcuugguaaagcgggug

SEQ ID NO: 52687 - RNA, 20 nt, Artificial Sequence
  CIITA targeting sequence
cggggucuuguacaguagaa

SEQ ID NO: 52688 - RNA, 20 nt, Artificial Sequence
  CIITA targeting sequence
uguacaguagaaugcagauc

SEQ ID NO: 52689 - RNA, 20 nt, Artificial Sequence
  CIITA targeting sequence
acuguacaagaccccgggaa

SEQ ID NO: 52690 - RNA, 20 nt, Artificial Sequence
  CIITA targeting sequence
gcauucuacuguacaagacc

SEQ ID NO: 52691 - RNA, 20 nt, Artificial Sequence
  CIITA targeting sequence
ugacccagaaggugcuggcg

SEQ ID NO: 52692 - RNA, 20 nt, Artificial Sequence
  CIITA targeting sequence
ggaucugcauucuacuguac

SEQ ID NO: 52693 - RNA, 20 nt, Artificial Sequence
  CIITA targeting sequence
gggucaggaucugcauucua

SEQ ID NO: 52694 - RNA, 20 nt, Artificial Sequence
  CIITA targeting sequence
gcauuuccagcaagguuccu

SEQ ID NO: 52695 - RNA, 20 nt, Artificial Sequence
  CIITA targeting sequence
agcaagguuccuagagaggu

SEQ ID NO: 52696 - RNA, 20 nt, Artificial Sequence
  CIITA targeting sequence
uagagaggucaguacugcug

SEQ ID NO: 52697 - RNA, 20 nt, Artificial Sequence
  CIITA targeting sequence
aggaaccuugcuggaaaugc

SEQ ID NO: 52698 - RNA, 20 nt, Artificial Sequence
  CIITA targeting sequence
cuaggaaccuugcuggaaau

SEQ ID NO: 52699 - RNA, 20 nt, Artificial Sequence
  CIITA targeting sequence
guacugcuggucugaggacc

SEQ ID NO: 52700 - RNA, 20 nt, Artificial Sequence
  CIITA targeting sequence
gaggaccgcacuuugaguag

SEQ ID NO: 52701 - RNA, 20 nt, Artificial Sequence
  CIITA targeting sequence
gaccagcaguacugaccucu

SEQ ID NO: 52702 - RNA, 20 nt, Artificial Sequence
  CIITA targeting sequence
ucagaccagcaguacugacc

SEQ ID NO: 52703 - RNA, 20 nt, Artificial Sequence
  CIITA targeting sequence
aagugcgguccucagaccag

SEQ ID NO: 52704 - RNA, 20 nt, Artificial Sequence
  CIITA targeting sequence
gaauuugaugugggucaugg

SEQ ID NO: 52705 - RNA, 20 nt, Artificial Sequence
  CIITA targeting sequence
gacuuuggcuacucaaagug

SEQ ID NO: 52706 - RNA, 20 nt, Artificial Sequence
  CIITA targeting sequence
aauucagacuuuggcuacuc

SEQ ID NO: 52707 - RNA, 20 nt, Artificial Sequence
  CIITA targeting sequence
ugguauacaccuguguaaaa

SEQ ID NO: 52708 - RNA, 20 nt, Artificial Sequence
  CIITA targeting sequence
aggccaggcgcagugacuca

SEQ ID NO: 52709 - RNA, 20 nt, Artificial Sequence
  CIITA targeting sequence
cugcgccuggccuggauagc

SEQ ID NO: 52710 - RNA, 20 nt, Artificial Sequence
  CIITA targeting sequence
ugccuguaaucccaacacuu

SEQ ID NO: 52711 - RNA, 20 nt, Artificial Sequence
  CIITA targeting sequence
caacacuuuaggaggccaag

SEQ ID NO: 52712 - RNA, 20 nt, Artificial Sequence
  CIITA targeting sequence
uaaaguguugggauuacagg

SEQ ID NO: 52713 - RNA, 20 nt, Artificial Sequence
  CIITA targeting sequence
caccuuggccuccuaaagug

SEQ ID NO: 52714 - RNA, 20 nt, Artificial Sequence
  CIITA targeting sequence
ucccaccuuggccuccuaaa

SEQ ID NO: 52715 - RNA, 20 nt, Artificial Sequence
  CIITA targeting sequence
ccugaggucaggaguuugag

SEQ ID NO: 52716 - RNA, 20 nt, Artificial Sequence
  CIITA targeting sequence
ggugauccucccaccuuggc

SEQ ID NO: 52717 - RNA, 20 nt, Artificial Sequence
  CIITA targeting sequence
ggaguuugagaccagccugg

SEQ ID NO: 52718 - RNA, 20 nt, Artificial Sequence
  CIITA targeting sequence
ugaccucaggugauccuccc

SEQ ID NO: 52719 - RNA, 20 nt, Artificial Sequence
  CIITA targeting sequence
aacuccugaccucaggugau

SEQ ID NO: 52720 - RNA, 20 nt, Artificial Sequence
  CIITA targeting sequence
caaacuccugaccucaggug

SEQ ID NO: 52721 - RNA, 20 nt, Artificial Sequence
  CIITA targeting sequence
acuaaaaauacaaaaacuag

SEQ ID NO: 52722 - RNA, 20 nt, Artificial Sequence
  CIITA targeting sequence
guagucccagcccuuuggga

SEQ ID NO: 52723 - RNA, 20 nt, Artificial Sequence
  CIITA targeting sequence
cagcccuuugggaggcugag

SEQ ID NO: 52724 - RNA, 20 nt, Artificial Sequence
  CIITA targeting sequence
caaagggcugggacuacaga

SEQ ID NO: 52725 - RNA, 20 nt, Artificial Sequence
  CIITA targeting sequence
gccucccaaagggcugggac

SEQ ID NO: 52726 - RNA, 20 nt, Artificial Sequence
  CIITA targeting sequence
cagccucccaaagggcuggg

SEQ ID NO: 52727 - RNA, 20 nt, Artificial Sequence
  CIITA targeting sequence
cgucucagccucccaaaggg

SEQ ID NO: 52728 - RNA, 20 nt, Artificial Sequence
  CIITA targeting sequence
cccgucucagccucccaaag

SEQ ID NO: 52729 - RNA, 20 nt, Artificial Sequence
  CIITA targeting sequence
caggaggucgaggcugcagu

SEQ ID NO: 52730 - RNA, 20 nt, Artificial Sequence
  CIITA targeting sequence
ugggauuaagcaauucuccc

SEQ ID NO: 52731 - RNA, 20 nt, Artificial Sequence
  CIITA targeting sequence
aggcugcagugagccaugau

SEQ ID NO: 52732 - RNA, 20 nt, Artificial Sequence
  CIITA targeting sequence
accuccugggauuaagcaau

SEQ ID NO: 52733 - RNA, 20 nt, Artificial Sequence
  CIITA targeting sequence
cugcagccucgaccuccugg

SEQ ID NO: 52734 - RNA, 20 nt, Artificial Sequence
  CIITA targeting sequence
uggcucacugcagccucgac

SEQ ID NO: 52735 - RNA, 20 nt, Artificial Sequence
  CIITA targeting sequence
ugccacugcacuccagccug

SEQ ID NO: 52736 - RNA, 20 nt, Artificial Sequence
  CIITA targeting sequence
agccugagugacagagugag

SEQ ID NO: 52737 - RNA, 20 nt, Artificial Sequence
  CIITA targeting sequence
ggcuggagugcaguggcacg

SEQ ID NO: 52738 - RNA, 20 nt, Artificial Sequence
  CIITA targeting sequence
cucaggcuggagugcagugg

SEQ ID NO: 52739 - RNA, 20 nt, Artificial Sequence
  CIITA targeting sequence
gucacucaggcuggagugca

SEQ ID NO: 52740 - RNA, 20 nt, Artificial Sequence
  CIITA targeting sequence
cucugucacucaggcuggag

SEQ ID NO: 52741 - RNA, 20 nt, Artificial Sequence
  CIITA targeting sequence
cacucugucacucaggcugg

SEQ ID NO: 52742 - RNA, 20 nt, Artificial Sequence
  CIITA targeting sequence
uaaaaaaaaaaggaaaaaaa

SEQ ID NO: 52743 - RNA, 20 nt, Artificial Sequence
  CIITA targeting sequence
uuuuuuuuuuaagagccagg

SEQ ID NO: 52744 - RNA, 20 nt, Artificial Sequence
  CIITA targeting sequence
agcugcacauuuaagaugag

SEQ ID NO: 52745 - RNA, 20 nt, Artificial Sequence
  CIITA targeting sequence
uaaaugugcagcuugauggc

SEQ ID NO: 52746 - RNA, 20 nt, Artificial Sequence
  CIITA targeting sequence
ucuuaaaugugcagcuugau

SEQ ID NO: 52747 - RNA, 20 nt, Artificial Sequence
  CIITA targeting sequence
ggucugaagguaguaaguua

SEQ ID NO: 52748 - RNA, 20 nt, Artificial Sequence
  CIITA targeting sequence
gaagguaguaaguuaucuca

SEQ ID NO: 52749 - RNA, 20 nt, Artificial Sequence
  CIITA targeting sequence
gaccagacaagugcacucau

SEQ ID NO: 52750 - RNA, 20 nt, Artificial Sequence
  CIITA targeting sequence
cagucaauuguucacaggca

SEQ ID NO: 52751 - RNA, 20 nt, Artificial Sequence
  CIITA targeting sequence
gucaauuguucacaggcagu

SEQ ID NO: 52752 - RNA, 20 nt, Artificial Sequence
  CIITA targeting sequence
auuguucacaggcaguuaca

SEQ ID NO: 52753 - RNA, 20 nt, Artificial Sequence
  CIITA targeting sequence
caggcaguuacagauccaac

SEQ ID NO: 52754 - RNA, 20 nt, Artificial Sequence
  CIITA targeting sequence
guaacugccugugaacaauu

SEQ ID NO: 52755 - RNA, 20 nt, Artificial Sequence
  CIITA targeting sequence
aacuccucauuuuacucuuu

SEQ ID NO: 52756 - RNA, 20 nt, Artificial Sequence
  CIITA targeting sequence
ucauuuuacucuuuccccuu

SEQ ID NO: 52757 - RNA, 20 nt, Artificial Sequence
  CIITA targeting sequence
uuuuacucuuuccccuuucu

SEQ ID NO: 52758 - RNA, 20 nt, Artificial Sequence
  CIITA targeting sequence
uuccccuuucucaugacugc

SEQ ID NO: 52759 - RNA, 20 nt, Artificial Sequence
  CIITA targeting sequence
ccuuucucaugacugcacuu

SEQ ID NO: 52760 - RNA, 20 nt, Artificial Sequence
  CIITA targeting sequence
caugacugcacuugacuagu

SEQ ID NO: 52761 - RNA, 20 nt, Artificial Sequence
  CIITA targeting sequence
ugacugcacuugacuagucu

SEQ ID NO: 52762 - RNA, 20 nt, Artificial Sequence
  CIITA targeting sequence
ugagaaaggggaaagaguaa

SEQ ID NO: 52763 - RNA, 20 nt, Artificial Sequence
  CIITA targeting sequence
agugcagucaugagaaaggg

SEQ ID NO: 52764 - RNA, 20 nt, Artificial Sequence
  CIITA targeting sequence
aaaagccaaaaagggcuggu

SEQ ID NO: 52765 - RNA, 20 nt, Artificial Sequence
  CIITA targeting sequence
cgccuguaaucucaacacuu

SEQ ID NO: 52766 - RNA, 20 nt, Artificial Sequence
  CIITA targeting sequence
caacacuuugggaggccgag

SEQ ID NO: 52767 - RNA, 20 nt, Artificial Sequence
  CIITA targeting sequence
acacuuugggaggccgaggu

SEQ ID NO: 52768 - RNA, 20 nt, Artificial Sequence
  CIITA targeting sequence
caaaguguugagauuacagg

SEQ ID NO: 52769 - RNA, 20 nt, Artificial Sequence
  CIITA targeting sequence
gccucccaaaguguugagau

SEQ ID NO: 52770 - RNA, 20 nt, Artificial Sequence
  CIITA targeting sequence
acccaccucggccucccaaa

SEQ ID NO: 52771 - RNA, 20 nt, Artificial Sequence
  CIITA targeting sequence
uuugagguuaggcguucgag

SEQ ID NO: 52772 - RNA, 20 nt, Artificial Sequence
  CIITA targeting sequence
aaugauccacccaccucggc

SEQ ID NO: 52773 - RNA, 20 nt, Artificial Sequence
  CIITA targeting sequence
agaccagccuggccaacaca

SEQ ID NO: 52774 - RNA, 20 nt, Artificial Sequence
  CIITA targeting sequence
aacgccuaaccucaaaugau

SEQ ID NO: 52775 - RNA, 20 nt, Artificial Sequence
  CIITA targeting sequence
cgaacgccuaaccucaaaug

SEQ ID NO: 52776 - RNA, 20 nt, Artificial Sequence
  CIITA targeting sequence
cuguguuggccaggcugguc

SEQ ID NO: 52777 - RNA, 20 nt, Artificial Sequence
  CIITA targeting sequence
cuacuaaaaauaaaaaguaa

SEQ ID NO: 52778 - RNA, 20 nt, Artificial Sequence
  CIITA targeting sequence
acuaaaaauaaaaaguaauu

SEQ ID NO: 52779 - RNA, 20 nt, Artificial Sequence
  CIITA targeting sequence
gcuacuggggaggcugaggg

SEQ ID NO: 52780 - RNA, 20 nt, Artificial Sequence
  CIITA targeting sequence
ccaguagcugagguuacagg

SEQ ID NO: 52781 - RNA, 20 nt, Artificial Sequence
  CIITA targeting sequence
gccuccccaguagcugaggu

SEQ ID NO: 52782 - RNA, 20 nt, Artificial Sequence
  CIITA targeting sequence
cucagccuccccaguagcug

SEQ ID NO: 52783 - RNA, 20 nt, Artificial Sequence
  CIITA targeting sequence
ucccucagccuccccaguag

SEQ ID NO: 52784 - RNA, 20 nt, Artificial Sequence
  CIITA targeting sequence
ccucccucagccuccccagu

SEQ ID NO: 52785 - RNA, 20 nt, Artificial Sequence
  CIITA targeting sequence
agcaauucuccucccucagc

SEQ ID NO: 52786 - RNA, 20 nt, Artificial Sequence
  CIITA targeting sequence
gccaccggguucaagcaauu

SEQ ID NO: 52787 - RNA, 20 nt, Artificial Sequence
  CIITA targeting sequence
cugccaccggguucaagcaa

SEQ ID NO: 52788 - RNA, 20 nt, Artificial Sequence
  CIITA targeting sequence
gucucugccaccggguucaa

SEQ ID NO: 52789 - RNA, 20 nt, Artificial Sequence
  CIITA targeting sequence
gucagucucugccaccgggu

SEQ ID NO: 52790 - RNA, 20 nt, Artificial Sequence
  CIITA targeting sequence
uggcucagucagucucugcc

SEQ ID NO: 52791 - RNA, 20 nt, Artificial Sequence
  CIITA targeting sequence
agccugggcgacagagcagg

SEQ ID NO: 52792 - RNA, 20 nt, Artificial Sequence
  CIITA targeting sequence
cccaggcuggagugcagugg

SEQ ID NO: 52793 - RNA, 20 nt, Artificial Sequence
  CIITA targeting sequence
gucgcccaggcuggagugca

SEQ ID NO: 52794 - RNA, 20 nt, Artificial Sequence
  CIITA targeting sequence
ugcucugucgcccaggcugg

SEQ ID NO: 52795 - RNA, 20 nt, Artificial Sequence
  CIITA targeting sequence
accucaaaaaauaaaaauaa

SEQ ID NO: 52796 - RNA, 20 nt, Artificial Sequence
  CIITA targeting sequence
aaaaauaaaaauaaaaaaau

SEQ ID NO: 52797 - RNA, 20 nt, Artificial Sequence
  CIITA targeting sequence
agcccaagaagggccgcagg

SEQ ID NO: 52798 - RNA, 20 nt, Artificial Sequence
  CIITA targeting sequence
ugggcuggauauuuuuuuau

SEQ ID NO: 52799 - RNA, 20 nt, Artificial Sequence
  CIITA targeting sequence
ugcggcccuucuugggcugg

SEQ ID NO: 52800 - RNA, 20 nt, Artificial Sequence
  CIITA targeting sequence
uccugcggcccuucuugggc

SEQ ID NO: 52801 - RNA, 20 nt, Artificial Sequence
  CIITA targeting sequence
gaaugguuaaugaaccauga

SEQ ID NO: 52802 - RNA, 20 nt, Artificial Sequence
  CIITA targeting sequence
gaguucauccugcggcccuu

SEQ ID NO: 52803 - RNA, 20 nt, Artificial Sequence
  CIITA targeting sequence
uuaaccauucugaguucauc

SEQ ID NO: 52804 - RNA, 20 nt, Artificial Sequence
  CIITA targeting sequence
ugguucauuaaccauucuga

SEQ ID NO: 52805 - RNA, 20 nt, Artificial Sequence
  CIITA targeting sequence
ccacuuggcucaugguucau

SEQ ID NO: 52806 - RNA, 20 nt, Artificial Sequence
  CIITA targeting sequence
ccucccccuccccaucuccu

SEQ ID NO: 52807 - RNA, 20 nt, Artificial Sequence
  CIITA targeting sequence
cccuccccaucuccuccaua

SEQ ID NO: 52808 - RNA, 20 nt, Artificial Sequence
  CIITA targeting sequence
ccaucuccuccauacacuca

SEQ ID NO: 52809 - RNA, 20 nt, Artificial Sequence
  CIITA targeting sequence
ccuccauacacucauccucc

SEQ ID NO: 52810 - RNA, 20 nt, Artificial Sequence
  CIITA targeting sequence
uccauacacucauccuccaa

SEQ ID NO: 52811 - RNA, 20 nt, Artificial Sequence
  CIITA targeting sequence
auacacucauccuccaacac

SEQ ID NO: 52812 - RNA, 20 nt, Artificial Sequence
  CIITA targeting sequence
uccuccaacacgcccuccug

SEQ ID NO: 52813 - RNA, 20 nt, Artificial Sequence
  CIITA targeting sequence
uccaacacgcccuccugguc

SEQ ID NO: 52814 - RNA, 20 nt, Artificial Sequence
  CIITA targeting sequence
aacacgcccuccugguccag

SEQ ID NO: 52815 - RNA, 20 nt, Artificial Sequence
  CIITA targeting sequence
ugguccaggugcuagggcgg

SEQ ID NO: 52816 - RNA, 20 nt, Artificial Sequence
  CIITA targeting sequence
aggugcuagggcgggaugca

SEQ ID NO: 52817 - RNA, 20 nt, Artificial Sequence
  CIITA targeting sequence
cgcccuagcaccuggaccag

SEQ ID NO: 52818 - RNA, 20 nt, Artificial Sequence
  CIITA targeting sequence
cauuccagcagggcagccgu

SEQ ID NO: 52819 - RNA, 20 nt, Artificial Sequence
  CIITA targeting sequence
agcagggcagccgugucugu

SEQ ID NO: 52820 - RNA, 20 nt, Artificial Sequence
  CIITA targeting sequence
gucucaggaaaugcgugugg

SEQ ID NO: 52821 - RNA, 20 nt, Artificial Sequence
  CIITA targeting sequence
caggaaaugcguguggucuc

SEQ ID NO: 52822 - RNA, 20 nt, Artificial Sequence
  CIITA targeting sequence
ggaaaugcguguggucucca

SEQ ID NO: 52823 - RNA, 20 nt, Artificial Sequence
  CIITA targeting sequence
ugagacagacacggcugccc

SEQ ID NO: 52824 - RNA, 20 nt, Artificial Sequence
  CIITA targeting sequence
ccagcucuggccgccaggag

SEQ ID NO: 52825 - RNA, 20 nt, Artificial Sequence
  CIITA targeting sequence
agcucuggccgccaggagac

SEQ ID NO: 52826 - RNA, 20 nt, Artificial Sequence
  CIITA targeting sequence
ggccgccaggagacaaagcc

SEQ ID NO: 52827 - RNA, 20 nt, Artificial Sequence
  CIITA targeting sequence
uggcggccagagcuggagac

SEQ ID NO: 52828 - RNA, 20 nt, Artificial Sequence
  CIITA targeting sequence
ccuggcggccagagcuggag

SEQ ID NO: 52829 - RNA, 20 nt, Artificial Sequence
  CIITA targeting sequence
uuggcccccagcaggagggg

SEQ ID NO: 52830 - RNA, 20 nt, Artificial Sequence
  CIITA targeting sequence
ugcugggggccaaggaacaa

SEQ ID NO: 52831 - RNA, 20 nt, Artificial Sequence
  CIITA targeting sequence
cccuccugcugggggccaag

SEQ ID NO: 52832 - RNA, 20 nt, Artificial Sequence
  CIITA targeting sequence
ccuucccccuccugcugggg

SEQ ID NO: 52833 - RNA, 20 nt, Artificial Sequence
  CIITA targeting sequence
ccccuucccccuccugcugg

SEQ ID NO: 52834 - RNA, 20 nt, Artificial Sequence
  CIITA targeting sequence
uuaggagagguuccaagaag

SEQ ID NO: 52835 - RNA, 20 nt, Artificial Sequence
  CIITA targeting sequence
uaaggaaauucuccccuucc

SEQ ID NO: 52836 - RNA, 20 nt, Artificial Sequence
  CIITA targeting sequence
ccuaaggaaauucuccccuu

SEQ ID NO: 52837 - RNA, 20 nt, Artificial Sequence
  CIITA targeting sequence
aagaagaggaauuacugcuu

SEQ ID NO: 52838 - RNA, 20 nt, Artificial Sequence
  CIITA targeting sequence
uggaaccucuccuaaggaaa

SEQ ID NO: 52839 - RNA, 20 nt, Artificial Sequence
  CIITA targeting sequence
ucuuggaaccucuccuaagg

SEQ ID NO: 52840 - RNA, 20 nt, Artificial Sequence
  CIITA targeting sequence
ucuucuuggaaccucuccua

SEQ ID NO: 52841 - RNA, 20 nt, Artificial Sequence
  CIITA targeting sequence
aagggagugcaccauuucag

SEQ ID NO: 52842 - RNA, 20 nt, Artificial Sequence
  CIITA targeting sequence
cuuugaagcaguaauuccuc

SEQ ID NO: 52843 - RNA, 20 nt, Artificial Sequence
  CIITA targeting sequence
ggcggcugagagcugcugcg

SEQ ID NO: 52844 - RNA, 20 nt, Artificial Sequence
  CIITA targeting sequence
gccgccugaaauggugcacu

SEQ ID NO: 52845 - RNA, 20 nt, Artificial Sequence
  CIITA targeting sequence
cagccgccugaaauggugca

SEQ ID NO: 52846 - RNA, 20 nt, Artificial Sequence
  CIITA targeting sequence
agaaggggcccggcaccccu

SEQ ID NO: 52847 - RNA, 20 nt, Artificial Sequence
  CIITA targeting sequence
ggaaggcggcgcagcagcuc

SEQ ID NO: 52848 - RNA, 20 nt, Artificial Sequence
  CIITA targeting sequence
cagcaugugggucccggcug

SEQ ID NO: 52849 - RNA, 20 nt, Artificial Sequence
  CIITA targeting sequence
cggcugggucugccuuaggg

SEQ ID NO: 52850 - RNA, 20 nt, Artificial Sequence
  CIITA targeting sequence
gccuuagggcccacucuccu

SEQ ID NO: 52851 - RNA, 20 nt, Artificial Sequence
  CIITA targeting sequence
ccugucaccugcucccucuc

SEQ ID NO: 52852 - RNA, 20 nt, Artificial Sequence
  CIITA targeting sequence
ugucaccugcucccucucuu

SEQ ID NO: 52853 - RNA, 20 nt, Artificial Sequence
  CIITA targeting sequence
ccugcucccucucuugcagu

SEQ ID NO: 52854 - RNA, 20 nt, Artificial Sequence
  CIITA targeting sequence
cucucuugcaguuggcgacc

SEQ ID NO: 52855 - RNA, 20 nt, Artificial Sequence
  CIITA targeting sequence
cuugcaguuggcgaccccug

SEQ ID NO: 52856 - RNA, 20 nt, Artificial Sequence
  CIITA targeting sequence
ugcaguuggcgaccccuggg

SEQ ID NO: 52857 - RNA, 20 nt, Artificial Sequence
  CIITA targeting sequence
ccaacugcaagagagggagc

SEQ ID NO: 52858 - RNA, 20 nt, Artificial Sequence
  CIITA targeting sequence
ccucugaguggccucugccc

SEQ ID NO: 52859 - RNA, 20 nt, Artificial Sequence
  CIITA targeting sequence
ucugaguggccucugcccuc

SEQ ID NO: 52860 - RNA, 20 nt, Artificial Sequence
  CIITA targeting sequence
gaguggccucugcccucagu

SEQ ID NO: 52861 - RNA, 20 nt, Artificial Sequence
  CIITA targeting sequence
gaggagaccccaggggucgc

SEQ ID NO: 52862 - RNA, 20 nt, Artificial Sequence
  CIITA targeting sequence
gcccucaguugcccacccac

SEQ ID NO: 52863 - RNA, 20 nt, Artificial Sequence
  CIITA targeting sequence
guugcccacccacccugccc

SEQ ID NO: 52864 - RNA, 20 nt, Artificial Sequence
  CIITA targeting sequence
uugcuguccucuuggugggg

SEQ ID NO: 52865 - RNA, 20 nt, Artificial Sequence
  CIITA targeting sequence
ucuugguggggauggauagc

SEQ ID NO: 52866 - RNA, 20 nt, Artificial Sequence
  CIITA targeting sequence
ugguggggauggauagcccc

SEQ ID NO: 52867 - RNA, 20 nt, Artificial Sequence
  CIITA targeting sequence
ccaccaagaggacagcaagg

SEQ ID NO: 52868 - RNA, 20 nt, Artificial Sequence
  CIITA targeting sequence
auccccaccaagaggacagc

SEQ ID NO: 52869 - RNA, 20 nt, Artificial Sequence
  CIITA targeting sequence
uuuccccuccccuacugccc

SEQ ID NO: 52870 - RNA, 20 nt, Artificial Sequence
  CIITA targeting sequence
ccuccccuacugccccacug

SEQ ID NO: 52871 - RNA, 20 nt, Artificial Sequence
  CIITA targeting sequence
ccuacugccccacugccuca

SEQ ID NO: 52872 - RNA, 20 nt, Artificial Sequence
  CIITA targeting sequence
cucucgucauuuauuuccuc

SEQ ID NO: 52873 - RNA, 20 nt, Artificial Sequence
  CIITA targeting sequence
cgucauuuauuuccucacuu

SEQ ID NO: 52874 - RNA, 20 nt, Artificial Sequence
  CIITA targeting sequence
ucauuuauuuccucacuuag

SEQ ID NO: 52875 - RNA, 20 nt, Artificial Sequence
  CIITA targeting sequence
uuuauuuccucacuuagguc

SEQ ID NO: 52876 - RNA, 20 nt, Artificial Sequence
  CIITA targeting sequence
ucacuuagguccuugucccu

SEQ ID NO: 52877 - RNA, 20 nt, Artificial Sequence
  CIITA targeting sequence
cuuagguccuugucccugaa

SEQ ID NO: 52878 - RNA, 20 nt, Artificial Sequence
  CIITA targeting sequence
uugucccugaagggccaugg

SEQ ID NO: 52879 - RNA, 20 nt, Artificial Sequence
  CIITA targeting sequence
cugaagggccauggagcuaa

SEQ ID NO: 52880 - RNA, 20 nt, Artificial Sequence
  CIITA targeting sequence
gggacaaggaccuaagugag

SEQ ID NO: 52881 - RNA, 20 nt, Artificial Sequence
  CIITA targeting sequence
auggcccuucagggacaagg

SEQ ID NO: 52882 - RNA, 20 nt, Artificial Sequence
  CIITA targeting sequence
cuuagcuccauggcccuuca

SEQ ID NO: 52883 - RNA, 20 nt, Artificial Sequence
  CIITA targeting sequence
cugggucccguguguguggu

SEQ ID NO: 52884 - RNA, 20 nt, Artificial Sequence
  CIITA targeting sequence
gggucccgugugugugguag

SEQ ID NO: 52885 - RNA, 20 nt, Artificial Sequence
  CIITA targeting sequence
cgugugugugguaggaaucu

SEQ ID NO: 52886 - RNA, 20 nt, Artificial Sequence
  CIITA targeting sequence
uaccacacacacgggaccca

SEQ ID NO: 52887 - RNA, 20 nt, Artificial Sequence
  CIITA targeting sequence
ucacacugccuugcugugac

SEQ ID NO: 52888 - RNA, 20 nt, Artificial Sequence
  CIITA targeting sequence
cacugccuugcugugaccgu

SEQ ID NO: 52889 - RNA, 20 nt, Artificial Sequence
  CIITA targeting sequence
cagcaaggcagugugaagau

SEQ ID NO: 52890 - RNA, 20 nt, Artificial Sequence
  CIITA targeting sequence
caucaccucccugugccuug

SEQ ID NO: 52891 - RNA, 20 nt, Artificial Sequence
  CIITA targeting sequence
ccucccugugccuugguuuc

SEQ ID NO: 52892 - RNA, 20 nt, Artificial Sequence
  CIITA targeting sequence
cugugccuugguuuccuggc

SEQ ID NO: 52893 - RNA, 20 nt, Artificial Sequence
  CIITA targeting sequence
uggccucuaaagacugaccu

SEQ ID NO: 52894 - RNA, 20 nt, Artificial Sequence
  CIITA targeting sequence
aaagacugaccuuaaggggu

SEQ ID NO: 52895 - RNA, 20 nt, Artificial Sequence
  CIITA targeting sequence
uuagaggccaggaaaccaag

SEQ ID NO: 52896 - RNA, 20 nt, Artificial Sequence
  CIITA targeting sequence
gucuuuagaggccaggaaac

SEQ ID NO: 52897 - RNA, 20 nt, Artificial Sequence
  CIITA targeting sequence
uuacaaacaaccccuuaagg

SEQ ID NO: 52898 - RNA, 20 nt, Artificial Sequence
  CIITA targeting sequence
uccuuacaaacaaccccuua

SEQ ID NO: 52899 - RNA, 20 nt, Artificial Sequence
  CIITA targeting sequence
uuagaauucucagcacauag

SEQ ID NO: 52900 - RNA, 20 nt, Artificial Sequence
  CIITA targeting sequence
aaggacuuggcuugcauuug

SEQ ID NO: 52901 - RNA, 20 nt, Artificial Sequence
  CIITA targeting sequence
cagcacauagcaagugcuca

SEQ ID NO: 52902 - RNA, 20 nt, Artificial Sequence
  CIITA targeting sequence
gcacauagcaagugcucaau

SEQ ID NO: 52903 - RNA, 20 nt, Artificial Sequence
  CIITA targeting sequence
augaaccgccuggcugcugu

SEQ ID NO: 52904 - RNA, 20 nt, Artificial Sequence
  CIITA targeting sequence
uugagcacuugcuaugugcu

SEQ ID NO: 52905 - RNA, 20 nt, Artificial Sequence
  CIITA targeting sequence
cuggggacacagucuuuugc

SEQ ID NO: 52906 - RNA, 20 nt, Artificial Sequence
  CIITA targeting sequence
ccagcgaacagcagccaggc

SEQ ID NO: 52907 - RNA, 20 nt, Artificial Sequence
  CIITA targeting sequence
uuugcucucuggaugucuga

SEQ ID NO: 52908 - RNA, 20 nt, Artificial Sequence
  CIITA targeting sequence
cuggaugucugaccgugccc

SEQ ID NO: 52909 - RNA, 20 nt, Artificial Sequence
  CIITA targeting sequence
ggaugucugaccgugcccug

SEQ ID NO: 52910 - RNA, 20 nt, Artificial Sequence
  CIITA targeting sequence
agagagcaaaagacuguguc

SEQ ID NO: 52911 - RNA, 20 nt, Artificial Sequence
  CIITA targeting sequence
gaccgugcccugucccugcc

SEQ ID NO: 52912 - RNA, 20 nt, Artificial Sequence
  CIITA targeting sequence
gacauccagagagcaaaaga

SEQ ID NO: 52913 - RNA, 20 nt, Artificial Sequence
  CIITA targeting sequence
cugccucacagggccaucca

SEQ ID NO: 52914 - RNA, 20 nt, Artificial Sequence
  CIITA targeting sequence
cagggccauccaucagugcu

SEQ ID NO: 52915 - RNA, 20 nt, Artificial Sequence
  CIITA targeting sequence
aucagugcuggugagcugag

SEQ ID NO: 52916 - RNA, 20 nt, Artificial Sequence
  CIITA targeting sequence
gugcuggugagcugagcuca

SEQ ID NO: 52917 - RNA, 20 nt, Artificial Sequence
  CIITA targeting sequence
ccagcacugauggauggccc

SEQ ID NO: 52918 - RNA, 20 nt, Artificial Sequence
  CIITA targeting sequence
gcucaccagcacugauggau

SEQ ID NO: 52919 - RNA, 20 nt, Artificial Sequence
  CIITA targeting sequence
gcugacaagccagccuggca

SEQ ID NO: 52920 - RNA, 20 nt, Artificial Sequence
  CIITA targeting sequence
gcugagcucagcucaccagc

SEQ ID NO: 52921 - RNA, 20 nt, Artificial Sequence
  CIITA targeting sequence
gugccaggcuggcuugucag

SEQ ID NO: 52922 - RNA, 20 nt, Artificial Sequence
  CIITA targeting sequence
ugcuggucccagauccguuc

SEQ ID NO: 52923 - RNA, 20 nt, Artificial Sequence
  CIITA targeting sequence
cagauccguucuguccggag

SEQ ID NO: 52924 - RNA, 20 nt, Artificial Sequence
  CIITA targeting sequence
gggaccagcaggaggggcag

SEQ ID NO: 52925 - RNA, 20 nt, Artificial Sequence
  CIITA targeting sequence
guucuguccggaggagaauu

SEQ ID NO: 52926 - RNA, 20 nt, Artificial Sequence
  CIITA targeting sequence
guccggaggagaauuucuua

SEQ ID NO: 52927 - RNA, 20 nt, Artificial Sequence
  CIITA targeting sequence
ggaggagaauuucuuauccc

SEQ ID NO: 52928 - RNA, 20 nt, Artificial Sequence
  CIITA targeting sequence
ggacagaacggaucugggac

SEQ ID NO: 52929 - RNA, 20 nt, Artificial Sequence
  CIITA targeting sequence
uccggacagaacggaucugg

SEQ ID NO: 52930 - RNA, 20 nt, Artificial Sequence
  CIITA targeting sequence
ccuccggacagaacggaucu

SEQ ID NO: 52931 - RNA, 20 nt, Artificial Sequence
  CIITA targeting sequence
uauccccaggagaugccugg

SEQ ID NO: 52932 - RNA, 20 nt, Artificial Sequence
  CIITA targeting sequence
ccaggagaugccuggccucg

SEQ ID NO: 52933 - RNA, 20 nt, Artificial Sequence
  CIITA targeting sequence
uggggauaagaaauucuccu

SEQ ID NO: 52934 - RNA, 20 nt, Artificial Sequence
  CIITA targeting sequence
ccuggggauaagaaauucuc

SEQ ID NO: 52935 - RNA, 20 nt, Artificial Sequence
  CIITA targeting sequence
uuaggagccuccucacccgc

SEQ ID NO: 52936 - RNA, 20 nt, Artificial Sequence
  CIITA targeting sequence
uaacgaggccaggcaucucc

SEQ ID NO: 52937 - RNA, 20 nt, Artificial Sequence
  CIITA targeting sequence
ucacccgcccgcccgcacca

SEQ ID NO: 52938 - RNA, 20 nt, Artificial Sequence
  CIITA targeting sequence
cccgcccgcccgcaccaacc

SEQ ID NO: 52939 - RNA, 20 nt, Artificial Sequence
  CIITA targeting sequence
gacucccuccaccucaccgc

SEQ ID NO: 52940 - RNA, 20 nt, Artificial Sequence
  CIITA targeting sequence
gaggguuggugcgggcgggc

SEQ ID NO: 52941 - RNA, 20 nt, Artificial Sequence
  CIITA targeting sequence
cuccaccucaccgccuggga

SEQ ID NO: 52942 - RNA, 20 nt, Artificial Sequence
  CIITA targeting sequence
accucaccgccugggaacaa

SEQ ID NO: 52943 - RNA, 20 nt, Artificial Sequence
  CIITA targeting sequence
ccgccugggaacaacaggaa

SEQ ID NO: 52944 - RNA, 20 nt, Artificial Sequence
  CIITA targeting sequence
caggcggugagguggaggga

SEQ ID NO: 52945 - RNA, 20 nt, Artificial Sequence
  CIITA targeting sequence
uguuguucccaggcggugag

SEQ ID NO: 52946 - RNA, 20 nt, Artificial Sequence
  CIITA targeting sequence
uccuguuguucccaggcggu

SEQ ID NO: 52947 - RNA, 20 nt, Artificial Sequence
  CIITA targeting sequence
cuuccuguuguucccaggcg

SEQ ID NO: 52948 - RNA, 20 nt, Artificial Sequence
  CIITA targeting sequence
ugcucucuuccuguuguucc

SEQ ID NO: 52949 - RNA, 20 nt, Artificial Sequence
  CIITA targeting sequence
gcugcuguccugcucucuuc

SEQ ID NO: 52950 - RNA, 20 nt, Artificial Sequence
  CIITA targeting sequence
uuucugcugcuguccugcuc

SEQ ID NO: 52951 - RNA, 20 nt, Artificial Sequence
  CIITA targeting sequence
ucucagaaucaggaggcucc

SEQ ID NO: 52952 - RNA, 20 nt, Artificial Sequence
  CIITA targeting sequence
cagaaucaggaggcucccag

SEQ ID NO: 52953 - RNA, 20 nt, Artificial Sequence
  CIITA targeting sequence
gaaucaggaggcucccaggc

SEQ ID NO: 52954 - RNA, 20 nt, Artificial Sequence
  CIITA targeting sequence
gagaagagccacauaagcag

SEQ ID NO: 52955 - RNA, 20 nt, Artificial Sequence
  CIITA targeting sequence
ggaggcucccaggccaggaa

SEQ ID NO: 52956 - RNA, 20 nt, Artificial Sequence
  CIITA targeting sequence
ugauucugagaagagccaca

SEQ ID NO: 52957 - RNA, 20 nt, Artificial Sequence
  CIITA targeting sequence
caggccaggaaugugaaacc

SEQ ID NO: 52958 - RNA, 20 nt, Artificial Sequence
  CIITA targeting sequence
uggccugggagccuccugau

SEQ ID NO: 52959 - RNA, 20 nt, Artificial Sequence
  CIITA targeting sequence
cauuccuggccugggagccu

SEQ ID NO: 52960 - RNA, 20 nt, Artificial Sequence
  CIITA targeting sequence
gcauaaugguuucacauucc

SEQ ID NO: 52961 - RNA, 20 nt, Artificial Sequence
  CIITA targeting sequence
ucugcauaaugguuucacau

SEQ ID NO: 52962 - RNA, 20 nt, Artificial Sequence
  CIITA targeting sequence
ucaucugcauaaugguuuca

SEQ ID NO: 52963 - RNA, 20 nt, Artificial Sequence
  CIITA targeting sequence
ucuucaucugcauaaugguu

SEQ ID NO: 52964 - RNA, 20 nt, Artificial Sequence
  CIITA targeting sequence
ucuucuucaucugcauaaug

SEQ ID NO: 52965 - RNA, 20 nt, Artificial Sequence
  CIITA targeting sequence
ggcuucaucuucuucaucug

SEQ ID NO: 52966 - RNA, 20 nt, Artificial Sequence
  CIITA targeting sequence
cgggcuucaucuucuucauc

SEQ ID NO: 52967 - RNA, 20 nt, Artificial Sequence
  CIITA targeting sequence
uaaccucucgggcuucaucu

SEQ ID NO: 52968 - RNA, 20 nt, Artificial Sequence
  CIITA targeting sequence
guuucauaaccucucgggcu

SEQ ID NO: 52969 - RNA, 20 nt, Artificial Sequence
  CIITA targeting sequence
cucuucagucucggcauaag

SEQ ID NO: 52970 - RNA, 20 nt, Artificial Sequence
  CIITA targeting sequence
ucagucucggcauaaggaau

SEQ ID NO: 52971 - RNA, 20 nt, Artificial Sequence
  CIITA targeting sequence
gucucggcauaaggaauccg

SEQ ID NO: 52972 - RNA, 20 nt, Artificial Sequence
  CIITA targeting sequence
cggcauaaggaauccggaac

SEQ ID NO: 52973 - RNA, 20 nt, Artificial Sequence
  CIITA targeting sequence
gcauaaggaauccggaaccu

SEQ ID NO: 52974 - RNA, 20 nt, Artificial Sequence
  CIITA targeting sequence
uuaugccgagacugaagagc

SEQ ID NO: 52975 - RNA, 20 nt, Artificial Sequence
  CIITA targeting sequence
ggaaccugggcccguguccg

SEQ ID NO: 52976 - RNA, 20 nt, Artificial Sequence
  CIITA targeting sequence
ggauuccuuaugccgagacu

SEQ ID NO: 52977 - RNA, 20 nt, Artificial Sequence
  CIITA targeting sequence
ggaacugcugugcccaggca

SEQ ID NO: 52978 - RNA, 20 nt, Artificial Sequence
  CIITA targeting sequence
ggacacgggcccagguuccg

SEQ ID NO: 52979 - RNA, 20 nt, Artificial Sequence
  CIITA targeting sequence
aggcaagcugccugggcaca

SEQ ID NO: 52980 - RNA, 20 nt, Artificial Sequence
  CIITA targeting sequence
gguagcguggggggacccca

SEQ ID NO: 52981 - RNA, 20 nt, Artificial Sequence
  CIITA targeting sequence
ccccacgcuaccugauuucc

SEQ ID NO: 52982 - RNA, 20 nt, Artificial Sequence
  CIITA targeting sequence
cccugugacagaccacgaau

SEQ ID NO: 52983 - RNA, 20 nt, Artificial Sequence
  CIITA targeting sequence
cagggggauuuugggguccc

SEQ ID NO: 52984 - RNA, 20 nt, Artificial Sequence
  CIITA targeting sequence
gucacagggggauuuugggg

SEQ ID NO: 52985 - RNA, 20 nt, Artificial Sequence
  CIITA targeting sequence
uggucugucacagggggauu

SEQ ID NO: 52986 - RNA, 20 nt, Artificial Sequence
  CIITA targeting sequence
gccguguuugugcaccucug

SEQ ID NO: 52987 - RNA, 20 nt, Artificial Sequence
  CIITA targeting sequence
guuuugcuucccagaaacga

SEQ ID NO: 52988 - RNA, 20 nt, Artificial Sequence
  CIITA targeting sequence
cagaaacgaaacuuuggcaa

SEQ ID NO: 52989 - RNA, 20 nt, Artificial Sequence
  CIITA targeting sequence
gggaagcaaaacagaggugc

SEQ ID NO: 52990 - RNA, 20 nt, Artificial Sequence
  CIITA targeting sequence
uuucugggaagcaaaacaga

SEQ ID NO: 52991 - RNA, 20 nt, Artificial Sequence
  CIITA targeting sequence
aguugccaaaguuucguuuc

SEQ ID NO: 52992 - RNA, 20 nt, Artificial Sequence
  CIITA targeting sequence
ccaguugccaaaguuucguu

SEQ ID NO: 52993 - RNA, 20 nt, Artificial Sequence
  CIITA targeting sequence
cucuccaguugccaaaguuu

SEQ ID NO: 52994 - RNA, 20 nt, Artificial Sequence
  CIITA targeting sequence
aucccucuccaguugccaaa

SEQ ID NO: 52995 - RNA, 20 nt, Artificial Sequence
  CIITA targeting sequence
ugcuguaccccacccgcccc

SEQ ID NO: 52996 - RNA, 20 nt, Artificial Sequence
  CIITA targeting sequence
ggaaacagcaccguccucaa

SEQ ID NO: 52997 - RNA, 20 nt, Artificial Sequence
  CIITA targeting sequence
cgaucuugcuguaccccacc

SEQ ID NO: 52998 - RNA, 20 nt, Artificial Sequence
  CIITA targeting sequence
ucaaaugccugcagaaggug

SEQ ID NO: 52999 - RNA, 20 nt, Artificial Sequence
  CIITA targeting sequence
aaugccugcagaaggugaga

SEQ ID NO: 53000 - RNA, 20 nt, Artificial Sequence
  CIITA targeting sequence
gcaggcauuugaggacggug

SEQ ID NO: 53001 - RNA, 20 nt, Artificial Sequence
  CIITA targeting sequence
ccuucugcaggcauuugagg

SEQ ID NO: 53002 - RNA, 20 nt, Artificial Sequence
  CIITA targeting sequence
caccuucugcaggcauuuga

SEQ ID NO: 53003 - RNA, 20 nt, Artificial Sequence
  CIITA targeting sequence
cucaccuucugcaggcauuu

SEQ ID NO: 53004 - RNA, 20 nt, Artificial Sequence
  CIITA targeting sequence
cacuugcugguucucucacc

SEQ ID NO: 53005 - RNA, 20 nt, Artificial Sequence
  CIITA targeting sequence
ucacacuugcugguucucuc

SEQ ID NO: 53006 - RNA, 20 nt, Artificial Sequence
  CIITA targeting sequence
cagccauuaccgugucuaaa

SEQ ID NO: 53007 - RNA, 20 nt, Artificial Sequence
  CIITA targeting sequence
aaaucucacaaccacacagu

SEQ ID NO: 53008 - RNA, 20 nt, Artificial Sequence
  CIITA targeting sequence
cacaaccacacagugaggaa

SEQ ID NO: 53009 - RNA, 20 nt, Artificial Sequence
  CIITA targeting sequence
caaccacacagugaggaagg

SEQ ID NO: 53010 - RNA, 20 nt, Artificial Sequence
  CIITA targeting sequence
cugugugguugugagauuua

SEQ ID NO: 53011 - RNA, 20 nt, Artificial Sequence
  CIITA targeting sequence
ucacugugugguugugagau

SEQ ID NO: 53012 - RNA, 20 nt, Artificial Sequence
  CIITA targeting sequence
guuuccauuuuauagauaag

SEQ ID NO: 53013 - RNA, 20 nt, Artificial Sequence
  CIITA targeting sequence
auuuuauagauaagcaaacu

SEQ ID NO: 53014 - RNA, 20 nt, Artificial Sequence
  CIITA targeting sequence
auaaaauggaaacagaaacc

SEQ ID NO: 53015 - RNA, 20 nt, Artificial Sequence
  CIITA targeting sequence
guuugcuuaucuauaaaaug

SEQ ID NO: 53016 - RNA, 20 nt, Artificial Sequence
  CIITA targeting sequence
gagaaaguaaagucacuugc

SEQ ID NO: 53017 - RNA, 20 nt, Artificial Sequence
  CIITA targeting sequence
gagccucaguuugcuuaucu

SEQ ID NO: 53018 - RNA, 20 nt, Artificial Sequence
  CIITA targeting sequence
cugagccucaguuugcuuau

SEQ ID NO: 53019 - RNA, 20 nt, Artificial Sequence
  CIITA targeting sequence
cuugcccaggagacacagcu

SEQ ID NO: 53020 - RNA, 20 nt, Artificial Sequence
  CIITA targeting sequence
ugggcaagugacuuuacuuu

SEQ ID NO: 53021 - RNA, 20 nt, Artificial Sequence
  CIITA targeting sequence
ccugggcaagugacuuuacu

SEQ ID NO: 53022 - RNA, 20 nt, Artificial Sequence
  CIITA targeting sequence
agcugugucuccugggcaag

SEQ ID NO: 53023 - RNA, 20 nt, Artificial Sequence
  CIITA targeting sequence
uuccagcugugucuccuggg

SEQ ID NO: 53024 - RNA, 20 nt, Artificial Sequence
  CIITA targeting sequence
cgcccugccuccuuccagcu

SEQ ID NO: 53025 - RNA, 20 nt, Artificial Sequence
  CIITA targeting sequence
uaauuguuuuuugguuuuuu

SEQ ID NO: 53026 - RNA, 20 nt, Artificial Sequence
  CIITA targeting sequence
aaccaggaagcucccagcag

SEQ ID NO: 53027 - RNA, 20 nt, Artificial Sequence
  CIITA targeting sequence
ccugcccauccaaccaggaa

SEQ ID NO: 53028 - RNA, 20 nt, Artificial Sequence
  CIITA targeting sequence
ccccugcccauccaaccagg

SEQ ID NO: 53029 - RNA, 20 nt, Artificial Sequence
  CIITA targeting sequence
ccagcucuccccugcccauc

SEQ ID NO: 53030 - RNA, 20 nt, Artificial Sequence
  CIITA targeting sequence
caacaugccaaaucgccagc

SEQ ID NO: 53031 - RNA, 20 nt, Artificial Sequence
  CIITA targeting sequence
cccugucccaacaugccaaa

SEQ ID NO: 53032 - RNA, 20 nt, Artificial Sequence
  CIITA targeting sequence
ucccccugucccaacaugcc

SEQ ID NO: 53033 - RNA, 20 nt, Artificial Sequence
  CIITA targeting sequence
gccugcucuucccccugucc

SEQ ID NO: 53034 - RNA, 20 nt, Artificial Sequence
  CIITA targeting sequence
aggccgagggcacacuccag

SEQ ID NO: 53035 - RNA, 20 nt, Artificial Sequence
  CIITA targeting sequence
gccuggaacacccuucugcc

SEQ ID NO: 53036 - RNA, 20 nt, Artificial Sequence
  CIITA targeting sequence
agugaaauccaggaguguag

SEQ ID NO: 53037 - RNA, 20 nt, Artificial Sequence
  CIITA targeting sequence
cuggagugugcccucggccu

SEQ ID NO: 53038 - RNA, 20 nt, Artificial Sequence
  CIITA targeting sequence
aggaguguagacuuugaugc

SEQ ID NO: 53039 - RNA, 20 nt, Artificial Sequence
  CIITA targeting sequence
uggauuucacuggagugugc

SEQ ID NO: 53040 - RNA, 20 nt, Artificial Sequence
  CIITA targeting sequence
acacuccuggauuucacugg

SEQ ID NO: 53041 - RNA, 20 nt, Artificial Sequence
  CIITA targeting sequence
aagucuacacuccuggauuu

SEQ ID NO: 53042 - RNA, 20 nt, Artificial Sequence
  CIITA targeting sequence
gggccccuugcugccccagc

SEQ ID NO: 53043 - RNA, 20 nt, Artificial Sequence
  CIITA targeting sequence
aaguggccugagcaaggugu

SEQ ID NO: 53044 - RNA, 20 nt, Artificial Sequence
  CIITA targeting sequence
ggccacuuugacugcagcca

SEQ ID NO: 53045 - RNA, 20 nt, Artificial Sequence
  CIITA targeting sequence
cuguguuucugaggcugacc

SEQ ID NO: 53046 - RNA, 20 nt, Artificial Sequence
  CIITA targeting sequence
guguuucugaggcugaccuc

SEQ ID NO: 53047 - RNA, 20 nt, Artificial Sequence
  CIITA targeting sequence
gaggcugaccucugugaacu

SEQ ID NO: 53048 - RNA, 20 nt, Artificial Sequence
  CIITA targeting sequence
gaaacacagagaacaccuug

SEQ ID NO: 53049 - RNA, 20 nt, Artificial Sequence
  CIITA targeting sequence
gccucagaaacacagagaac

SEQ ID NO: 53050 - RNA, 20 nt, Artificial Sequence
  CIITA targeting sequence
gugaacucagagagagaaag

SEQ ID NO: 53051 - RNA, 20 nt, Artificial Sequence
  CIITA targeting sequence
cagaggucagccucagaaac

SEQ ID NO: 53052 - RNA, 20 nt, Artificial Sequence
  CIITA targeting sequence
gagagagaaagagagagaag

SEQ ID NO: 53053 - RNA, 20 nt, Artificial Sequence
  CIITA targeting sequence
gaguucacagaggucagccu

SEQ ID NO: 53054 - RNA, 20 nt, Artificial Sequence
  CIITA targeting sequence
cugaguucacagaggucagc

SEQ ID NO: 53055 - RNA, 20 nt, Artificial Sequence
  CIITA targeting sequence
cucugaguucacagagguca

SEQ ID NO: 53056 - RNA, 20 nt, Artificial Sequence
  CIITA targeting sequence
cucucugaguucacagaggu

SEQ ID NO: 53057 - RNA, 20 nt, Artificial Sequence
  CIITA targeting sequence
uucucucucugaguucacag

SEQ ID NO: 53058 - RNA, 20 nt, Artificial Sequence
  CIITA targeting sequence
cuuucucucucugaguucac

SEQ ID NO: 53059 - RNA, 20 nt, Artificial Sequence
  CIITA targeting sequence
cucuuucucucucugaguuc

SEQ ID NO: 53060 - RNA, 20 nt, Artificial Sequence
  CIITA targeting sequence
cucucuuucucucucugagu

SEQ ID NO: 53061 - RNA, 20 nt, Artificial Sequence
  CIITA targeting sequence
cuucucucucuuucucucuc

SEQ ID NO: 53062 - RNA, 20 nt, Artificial Sequence
  CIITA targeting sequence
ggcaggcuugugggacagug

SEQ ID NO: 53063 - RNA, 20 nt, Artificial Sequence
  CIITA targeting sequence
cacaagccugccagaccgca

SEQ ID NO: 53064 - RNA, 20 nt, Artificial Sequence
  CIITA targeting sequence
cuugugugugcagggcugcu

SEQ ID NO: 53065 - RNA, 20 nt, Artificial Sequence
  CIITA targeting sequence
ugugugugcagggcugcuug

SEQ ID NO: 53066 - RNA, 20 nt, Artificial Sequence
  CIITA targeting sequence
aagcagcccugcacacacaa

SEQ ID NO: 53067 - RNA, 20 nt, Artificial Sequence
  CIITA targeting sequence
ugggcucuugggugugugug

SEQ ID NO: 53068 - RNA, 20 nt, Artificial Sequence
  CIITA targeting sequence
ugggugugugugagugugug

SEQ ID NO: 53069 - RNA, 20 nt, Artificial Sequence
  CIITA targeting sequence
cacacacccaagagcccagg

SEQ ID NO: 53070 - RNA, 20 nt, Artificial Sequence
  CIITA targeting sequence
acugguggaaaaugggugua

SEQ ID NO: 53071 - RNA, 20 nt, Artificial Sequence
  CIITA targeting sequence
accaguggaaacacacacac

SEQ ID NO: 53072 - RNA, 20 nt, Artificial Sequence
  CIITA targeting sequence
cuuggcaggagcugggaaug

SEQ ID NO: 53073 - RNA, 20 nt, Artificial Sequence
  CIITA targeting sequence
uggcaggagcugggaaugug

SEQ ID NO: 53074 - RNA, 20 nt, Artificial Sequence
  CIITA targeting sequence
ugccaagagauacacccauu

SEQ ID NO: 53075 - RNA, 20 nt, Artificial Sequence
  CIITA targeting sequence
cagcuccugccaagagauac

SEQ ID NO: 53076 - RNA, 20 nt, Artificial Sequence
  CIITA targeting sequence
cauucccagcuccugccaag

SEQ ID NO: 53077 - RNA, 20 nt, Artificial Sequence
  CIITA targeting sequence
gagguccagggagagcaagc

SEQ ID NO: 53078 - RNA, 20 nt, Artificial Sequence
  CIITA targeting sequence
gacccacucacauucccagc

SEQ ID NO: 53079 - RNA, 20 nt, Artificial Sequence
  CIITA targeting sequence
agggagagcaagccuacggu

SEQ ID NO: 53080 - RNA, 20 nt, Artificial Sequence
  CIITA targeting sequence
cuggaccucagacccacuca

SEQ ID NO: 53081 - RNA, 20 nt, Artificial Sequence
  CIITA targeting sequence
cccuggaccucagacccacu

SEQ ID NO: 53082 - RNA, 20 nt, Artificial Sequence
  CIITA targeting sequence
gcccacuugcaaccguaggc

SEQ ID NO: 53083 - RNA, 20 nt, Artificial Sequence
  CIITA targeting sequence
cguagucugcccacuugcaa

SEQ ID NO: 53084 - RNA, 20 nt, Artificial Sequence
  CIITA targeting sequence
cacguagucugcccacuugc

SEQ ID NO: 53085 - RNA, 20 nt, Artificial Sequence
  CIITA targeting sequence
gggagccuuugugucugugu

SEQ ID NO: 53086 - RNA, 20 nt, Artificial Sequence
  CIITA targeting sequence
cagaccccucucacguaguc

SEQ ID NO: 53087 - RNA, 20 nt, Artificial Sequence
  CIITA targeting sequence
gugugcaugcguaugugugc

SEQ ID NO: 53088 - RNA, 20 nt, Artificial Sequence
  CIITA targeting sequence
gaguguaugcaugaguggau

SEQ ID NO: 53089 - RNA, 20 nt, Artificial Sequence
  CIITA targeting sequence
gaggcgcaggcacacauacg

SEQ ID NO: 53090 - RNA, 20 nt, Artificial Sequence
  CIITA targeting sequence
ugcauacacucugaggcgca

SEQ ID NO: 53091 - RNA, 20 nt, Artificial Sequence
  CIITA targeting sequence
acucaugcauacacucugag

SEQ ID NO: 53092 - RNA, 20 nt, Artificial Sequence
  CIITA targeting sequence
uccacucaugcauacacucu

SEQ ID NO: 53093 - RNA, 20 nt, Artificial Sequence
  CIITA targeting sequence
ugcacacacaugcaugugug

SEQ ID NO: 53094 - RNA, 20 nt, Artificial Sequence
  CIITA targeting sequence
cauacacauaagcauauaua

SEQ ID NO: 53095 - RNA, 20 nt, Artificial Sequence
  CIITA targeting sequence
cucccauacacauaagcaua

SEQ ID NO: 53096 - RNA, 20 nt, Artificial Sequence
  CIITA targeting sequence
gcuugugucugcaauagccu

SEQ ID NO: 53097 - RNA, 20 nt, Artificial Sequence
  CIITA targeting sequence
gcaauagccugagugugcau

SEQ ID NO: 53098 - RNA, 20 nt, Artificial Sequence
  CIITA targeting sequence
ggcuauugcagacacaagca

SEQ ID NO: 53099 - RNA, 20 nt, Artificial Sequence
  CIITA targeting sequence
cacgcaugcacacucaggcu

SEQ ID NO: 53100 - RNA, 20 nt, Artificial Sequence
  CIITA targeting sequence
cauucagugcuagucagagg

SEQ ID NO: 53101 - RNA, 20 nt, Artificial Sequence
  CIITA targeting sequence
gugcuagucagaggcuccaa

SEQ ID NO: 53102 - RNA, 20 nt, Artificial Sequence
  CIITA targeting sequence
gaggcuccaauuccuguaaa

SEQ ID NO: 53103 - RNA, 20 nt, Artificial Sequence
  CIITA targeting sequence
gacuagcacugaaugugaaa

SEQ ID NO: 53104 - RNA, 20 nt, Artificial Sequence
  CIITA targeting sequence
aauuccuguaaaccucaugg

SEQ ID NO: 53105 - RNA, 20 nt, Artificial Sequence
  CIITA targeting sequence
uguaaaccucauggucucau

SEQ ID NO: 53106 - RNA, 20 nt, Artificial Sequence
  CIITA targeting sequence
uggucucaucuuccagcaga

SEQ ID NO: 53107 - RNA, 20 nt, Artificial Sequence
  CIITA targeting sequence
caucuuccagcagacauccc

SEQ ID NO: 53108 - RNA, 20 nt, Artificial Sequence
  CIITA targeting sequence
ucuuccagcagacaucccac

SEQ ID NO: 53109 - RNA, 20 nt, Artificial Sequence
  CIITA targeting sequence
uccagcagacaucccacagc

SEQ ID NO: 53110 - RNA, 20 nt, Artificial Sequence
  CIITA targeting sequence
agcagacaucccacagcagu

SEQ ID NO: 53111 - RNA, 20 nt, Artificial Sequence
  CIITA targeting sequence
gcuggaagaugagaccauga

SEQ ID NO: 53112 - RNA, 20 nt, Artificial Sequence
  CIITA targeting sequence
cacagcaguggcagugggca

SEQ ID NO: 53113 - RNA, 20 nt, Artificial Sequence
  CIITA targeting sequence
agccuaggcuguggugccca

SEQ ID NO: 53114 - RNA, 20 nt, Artificial Sequence
  CIITA targeting sequence
gacuuauggcuuccccuuuu

SEQ ID NO: 53115 - RNA, 20 nt, Artificial Sequence
  CIITA targeting sequence
gaucaagccuaggcuguggu

SEQ ID NO: 53116 - RNA, 20 nt, Artificial Sequence
  CIITA targeting sequence
ccuuuucaagccucugguug

SEQ ID NO: 53117 - RNA, 20 nt, Artificial Sequence
  CIITA targeting sequence
agccucugguugcagggugu

SEQ ID NO: 53118 - RNA, 20 nt, Artificial Sequence
  CIITA targeting sequence
gguugcaggguguagagggg

SEQ ID NO: 53119 - RNA, 20 nt, Artificial Sequence
  CIITA targeting sequence
acacccugcaaccagaggcu

SEQ ID NO: 53120 - RNA, 20 nt, Artificial Sequence
  CIITA targeting sequence
ccucuacacccugcaaccag

SEQ ID NO: 53121 - RNA, 20 nt, Artificial Sequence
  CIITA targeting sequence
ccuacauccccucuacaccc

SEQ ID NO: 53122 - RNA, 20 nt, Artificial Sequence
  CIITA targeting sequence
ugccuucaccuacauccccu

SEQ ID NO: 53123 - RNA, 20 nt, Artificial Sequence
  CIITA targeting sequence
cuggcaucugcggcaugaag

SEQ ID NO: 53124 - RNA, 20 nt, Artificial Sequence
  CIITA targeting sequence
gcggcaugaagccacccaug

SEQ ID NO: 53125 - RNA, 20 nt, Artificial Sequence
  CIITA targeting sequence
ugccgcagaugccagggaug

SEQ ID NO: 53126 - RNA, 20 nt, Artificial Sequence
  CIITA targeting sequence
cauggguggcuucaugccgc

SEQ ID NO: 53127 - RNA, 20 nt, Artificial Sequence
  CIITA targeting sequence
gagggaagucacauuacugg

SEQ ID NO: 53128 - RNA, 20 nt, Artificial Sequence
  CIITA targeting sequence
gacucccauggguggcuuca

SEQ ID NO: 53129 - RNA, 20 nt, Artificial Sequence
  CIITA targeting sequence
cucagacucccauggguggc

SEQ ID NO: 53130 - RNA, 20 nt, Artificial Sequence
  CIITA targeting sequence
cauuacugggacuggccagg

SEQ ID NO: 53131 - RNA, 20 nt, Artificial Sequence
  CIITA targeting sequence
caguaaugugacuucccuca

SEQ ID NO: 53132 - RNA, 20 nt, Artificial Sequence
  CIITA targeting sequence
acccuggccagucccaguaa

SEQ ID NO: 53133 - RNA, 20 nt, Artificial Sequence
  CIITA targeting sequence
cagggcagcucuacccuggc

SEQ ID NO: 53134 - RNA, 20 nt, Artificial Sequence
  CIITA targeting sequence
cuuucauucuacugaaggug

SEQ ID NO: 53135 - RNA, 20 nt, Artificial Sequence
  CIITA targeting sequence
uucuacugaaggugaaaauc

SEQ ID NO: 53136 - RNA, 20 nt, Artificial Sequence
  CIITA targeting sequence
acugaaggugaaaaucagau

SEQ ID NO: 53137 - RNA, 20 nt, Artificial Sequence
  CIITA targeting sequence
guagaaugaaagugaaccca

SEQ ID NO: 53138 - RNA, 20 nt, Artificial Sequence
  CIITA targeting sequence
ccuucaguagaaugaaagug

SEQ ID NO: 53139 - RNA, 20 nt, Artificial Sequence
  CIITA targeting sequence
gaucacgccucuccucuguc

SEQ ID NO: 53140 - RNA, 20 nt, Artificial Sequence
  CIITA targeting sequence
gauuuucaccuucaguagaa

SEQ ID NO: 53141 - RNA, 20 nt, Artificial Sequence
  CIITA targeting sequence
cgccucuccucugucucucu

SEQ ID NO: 53142 - RNA, 20 nt, Artificial Sequence
  CIITA targeting sequence
ccucugucucucugaaaacc

SEQ ID NO: 53143 - RNA, 20 nt, Artificial Sequence
  CIITA targeting sequence
ucugucucucugaaaacccu

SEQ ID NO: 53144 - RNA, 20 nt, Artificial Sequence
  CIITA targeting sequence
gucucucugaaaacccucca

SEQ ID NO: 53145 - RNA, 20 nt, Artificial Sequence
  CIITA targeting sequence
cucugaaaacccuccaaaga

SEQ ID NO: 53146 - RNA, 20 nt, Artificial Sequence
  CIITA targeting sequence
cugaaaacccuccaaagagu

SEQ ID NO: 53147 - RNA, 20 nt, Artificial Sequence
  CIITA targeting sequence
gaaaacccuccaaagagucc

SEQ ID NO: 53148 - RNA, 20 nt, Artificial Sequence
  CIITA targeting sequence
gagagacagaggagaggcgu

SEQ ID NO: 53149 - RNA, 20 nt, Artificial Sequence
  CIITA targeting sequence
aaagagucccuguugcauuu

SEQ ID NO: 53150 - RNA, 20 nt, Artificial Sequence
  CIITA targeting sequence
uuggaggguuuucagagaga

SEQ ID NO: 53151 - RNA, 20 nt, Artificial Sequence
  CIITA targeting sequence
cuguugcauuucaagcgaaa

SEQ ID NO: 53152 - RNA, 20 nt, Artificial Sequence
  CIITA targeting sequence
agcgaaacaugagucucuac

SEQ ID NO: 53153 - RNA, 20 nt, Artificial Sequence
  CIITA targeting sequence
cuugaaaugcaacagggacu

SEQ ID NO: 53154 - RNA, 20 nt, Artificial Sequence
  CIITA targeting sequence
uguuucgcuugaaaugcaac

SEQ ID NO: 53155 - RNA, 20 nt, Artificial Sequence
  CIITA targeting sequence
cuacccaguaucucagaugu

SEQ ID NO: 53156 - RNA, 20 nt, Artificial Sequence
  CIITA targeting sequence
acccaguaucucagauguca

SEQ ID NO: 53157 - RNA, 20 nt, Artificial Sequence
  CIITA targeting sequence
cagaugucaccagggcccug

SEQ ID NO: 53158 - RNA, 20 nt, Artificial Sequence
  CIITA targeting sequence
gaugucaccagggcccugcu

SEQ ID NO: 53159 - RNA, 20 nt, Artificial Sequence
  CIITA targeting sequence
gagauacuggguagagacuc

SEQ ID NO: 53160 - RNA, 20 nt, Artificial Sequence
  CIITA targeting sequence
ccagggcccugcuggccaga

SEQ ID NO: 53161 - RNA, 20 nt, Artificial Sequence
  CIITA targeting sequence
ggccagcagggcccugguga

SEQ ID NO: 53162 - RNA, 20 nt, Artificial Sequence
  CIITA targeting sequence
uucuggccagcagggcccug

SEQ ID NO: 53163 - RNA, 20 nt, Artificial Sequence
  CIITA targeting sequence
caagucuuucuggccagcag

SEQ ID NO: 53164 - RNA, 20 nt, Artificial Sequence
  CIITA targeting sequence
uucccaagucuuucuggcca

SEQ ID NO: 53165 - RNA, 20 nt, Artificial Sequence
  CIITA targeting sequence
acugugucacucuuggcuuc

SEQ ID NO: 53166 - RNA, 20 nt, Artificial Sequence
  CIITA targeting sequence
cucuuggcuucgagucccuu

SEQ ID NO: 53167 - RNA, 20 nt, Artificial Sequence
  CIITA targeting sequence
uggcuucgagucccuuccug

SEQ ID NO: 53168 - RNA, 20 nt, Artificial Sequence
  CIITA targeting sequence
agucccuuccuguaaaagcu

SEQ ID NO: 53169 - RNA, 20 nt, Artificial Sequence
  CIITA targeting sequence
aagccaagagugacacagug

SEQ ID NO: 53170 - RNA, 20 nt, Artificial Sequence
  CIITA targeting sequence
cuuccuguaaaagcugagua

SEQ ID NO: 53171 - RNA, 20 nt, Artificial Sequence
  CIITA targeting sequence
uguaaaagcugaguaggaag

SEQ ID NO: 53172 - RNA, 20 nt, Artificial Sequence
  CIITA targeting sequence
gcuuuuacaggaagggacuc

SEQ ID NO: 53173 - RNA, 20 nt, Artificial Sequence
  CIITA targeting sequence
uacucagcuuuuacaggaag

SEQ ID NO: 53174 - RNA, 20 nt, Artificial Sequence
  CIITA targeting sequence
uugcagggggcagggaugau

SEQ ID NO: 53175 - RNA, 20 nt, Artificial Sequence
  CIITA targeting sequence
cugcccccugcaaggacuuc

SEQ ID NO: 53176 - RNA, 20 nt, Artificial Sequence
  CIITA targeting sequence
ucccugcccccugcaaggac

SEQ ID NO: 53177 - RNA, 20 nt, Artificial Sequence
  CIITA targeting sequence
ucuguccaguggguagacac

SEQ ID NO: 53178 - RNA, 20 nt, Artificial Sequence
  CIITA targeting sequence
guccaguggguagacacugg

SEQ ID NO: 53179 - RNA, 20 nt, Artificial Sequence
  CIITA targeting sequence
aguggguagacacugggagg

SEQ ID NO: 53180 - RNA, 20 nt, Artificial Sequence
  CIITA targeting sequence
acccacuggacagaggaacg

SEQ ID NO: 53181 - RNA, 20 nt, Artificial Sequence
  CIITA targeting sequence
cagugucuacccacuggaca

SEQ ID NO: 53182 - RNA, 20 nt, Artificial Sequence
  CIITA targeting sequence
ggagacuuggccaugaagga

SEQ ID NO: 53183 - RNA, 20 nt, Artificial Sequence
  CIITA targeting sequence
agagccucccagugucuacc

SEQ ID NO: 53184 - RNA, 20 nt, Artificial Sequence
  CIITA targeting sequence
ccagagccucccagugucua

SEQ ID NO: 53185 - RNA, 20 nt, Artificial Sequence
  CIITA targeting sequence
uggccaagucuccagagccu

SEQ ID NO: 53186 - RNA, 20 nt, Artificial Sequence
  CIITA targeting sequence
uucauggccaagucuccaga

SEQ ID NO: 53187 - RNA, 20 nt, Artificial Sequence
  CIITA targeting sequence
ccuucauggccaagucucca

SEQ ID NO: 53188 - RNA, 20 nt, Artificial Sequence
  CIITA targeting sequence
cggugggccagagccuuuuc

SEQ ID NO: 53189 - RNA, 20 nt, Artificial Sequence
  CIITA targeting sequence
ggcccaccgggagggcuguc

SEQ ID NO: 53190 - RNA, 20 nt, Artificial Sequence
  CIITA targeting sequence
cuuuccauauagccauaugc

SEQ ID NO: 53191 - RNA, 20 nt, Artificial Sequence
  CIITA targeting sequence
auauagccauaugcgauagu

SEQ ID NO: 53192 - RNA, 20 nt, Artificial Sequence
  CIITA targeting sequence
cauauggcuauauggaaagg

SEQ ID NO: 53193 - RNA, 20 nt, Artificial Sequence
  CIITA targeting sequence
uuacuaucgcauauggcuau

SEQ ID NO: 53194 - RNA, 20 nt, Artificial Sequence
  CIITA targeting sequence
ccaggcuuuaaaaaauuuuu

SEQ ID NO: 53195 - RNA, 20 nt, Artificial Sequence
  CIITA targeting sequence
ucccaccucagccucccaaa

SEQ ID NO: 53196 - RNA, 20 nt, Artificial Sequence
  CIITA targeting sequence
caccucagccucccaaagug

SEQ ID NO: 53197 - RNA, 20 nt, Artificial Sequence
  CIITA targeting sequence
gccucccaaagugcugggau

SEQ ID NO: 53198 - RNA, 20 nt, Artificial Sequence
  CIITA targeting sequence
caaagugcugggauuacagg

SEQ ID NO: 53199 - RNA, 20 nt, Artificial Sequence
  CIITA targeting sequence
cagcacuuugggaggcugag

SEQ ID NO: 53200 - RNA, 20 nt, Artificial Sequence
  CIITA targeting sequence
cucaugccauuucugugcca

SEQ ID NO: 53201 - RNA, 20 nt, Artificial Sequence
  CIITA targeting sequence
ugccauuucugugccacuag

SEQ ID NO: 53202 - RNA, 20 nt, Artificial Sequence
  CIITA targeting sequence
gugccacuaggaaguaacac

SEQ ID NO: 53203 - RNA, 20 nt, Artificial Sequence
  CIITA targeting sequence
uaguggcacagaaauggcau

SEQ ID NO: 53204 - RNA, 20 nt, Artificial Sequence
  CIITA targeting sequence
accugguuagccaguguuac

SEQ ID NO: 53205 - RNA, 20 nt, Artificial Sequence
  CIITA targeting sequence
cuuguucccagagugaaacg

SEQ ID NO: 53206 - RNA, 20 nt, Artificial Sequence
  CIITA targeting sequence
uguucccagagugaaacgaa

SEQ ID NO: 53207 - RNA, 20 nt, Artificial Sequence
  CIITA targeting sequence
cagagugaaacgaaugagug

SEQ ID NO: 53208 - RNA, 20 nt, Artificial Sequence
  CIITA targeting sequence
gggaacaagagaaaugucaa

SEQ ID NO: 53209 - RNA, 20 nt, Artificial Sequence
  CIITA targeting sequence
cucugggaacaagagaaaug

SEQ ID NO: 53210 - RNA, 20 nt, Artificial Sequence
  CIITA targeting sequence
uuucacucugggaacaagag

SEQ ID NO: 53211 - RNA, 20 nt, Artificial Sequence
  CIITA targeting sequence
uucguuucacucugggaaca

SEQ ID NO: 53212 - RNA, 20 nt, Artificial Sequence
  CIITA targeting sequence
ucuuuaauccugcaacuacc

SEQ ID NO: 53213 - RNA, 20 nt, Artificial Sequence
  CIITA targeting sequence
uuaauccugcaacuacccca

SEQ ID NO: 53214 - RNA, 20 nt, Artificial Sequence
  CIITA targeting sequence
ugcaacuaccccacaugguc

SEQ ID NO: 53215 - RNA, 20 nt, Artificial Sequence
  CIITA targeting sequence
gcacuuauauuuucacucuu

SEQ ID NO: 53216 - RNA, 20 nt, Artificial Sequence
  CIITA targeting sequence
cucuuacuuggcagaugaag

SEQ ID NO: 53217 - RNA, 20 nt, Artificial Sequence
  CIITA targeting sequence
uacuuggcagaugaagaaau

SEQ ID NO: 53218 - RNA, 20 nt, Artificial Sequence
  CIITA targeting sequence
gccaaguaagagugaaaaua

SEQ ID NO: 53219 - RNA, 20 nt, Artificial Sequence
  CIITA targeting sequence
ucugccaaguaagagugaaa

SEQ ID NO: 53220 - RNA, 20 nt, Artificial Sequence
  CIITA targeting sequence
ucaucugccaaguaagagug

SEQ ID NO: 53221 - RNA, 20 nt, Artificial Sequence
  CIITA targeting sequence
auuucuucaucugccaagua

SEQ ID NO: 53222 - RNA, 20 nt, Artificial Sequence
  CIITA targeting sequence
uguuaaggaacgugcuuagg

SEQ ID NO: 53223 - RNA, 20 nt, Artificial Sequence
  CIITA targeting sequence
uuaacaggacucaauuucuu

SEQ ID NO: 53224 - RNA, 20 nt, Artificial Sequence
  CIITA targeting sequence
uaagcacguuccuuaacagg

SEQ ID NO: 53225 - RNA, 20 nt, Artificial Sequence
  CIITA targeting sequence
caugcuaggagguggucgug

SEQ ID NO: 53226 - RNA, 20 nt, Artificial Sequence
  CIITA targeting sequence
uagcaugugauccuaagcac

SEQ ID NO: 53227 - RNA, 20 nt, Artificial Sequence
  CIITA targeting sequence
ugcuggaauucaaauccagg

SEQ ID NO: 53228 - RNA, 20 nt, Artificial Sequence
  CIITA targeting sequence
agcacgaccaccuccuagca

SEQ ID NO: 53229 - RNA, 20 nt, Artificial Sequence
  CIITA targeting sequence
aauccaggcaggugcuagcu

SEQ ID NO: 53230 - RNA, 20 nt, Artificial Sequence
  CIITA targeting sequence
aggcaggugcuagcuugaga

SEQ ID NO: 53231 - RNA, 20 nt, Artificial Sequence
  CIITA targeting sequence
agcuagcaccugccuggauu

SEQ ID NO: 53232 - RNA, 20 nt, Artificial Sequence
  CIITA targeting sequence
caagcuagcaccugccugga

SEQ ID NO: 53233 - RNA, 20 nt, Artificial Sequence
  CIITA targeting sequence
auaaagcccuucucaggccu

SEQ ID NO: 53234 - RNA, 20 nt, Artificial Sequence
  CIITA targeting sequence
caggccuccacucaggccaa

SEQ ID NO: 53235 - RNA, 20 nt, Artificial Sequence
  CIITA targeting sequence
ggccuccacucaggccaagg

SEQ ID NO: 53236 - RNA, 20 nt, Artificial Sequence
  CIITA targeting sequence
acucaggccaagggaggagg

SEQ ID NO: 53237 - RNA, 20 nt, Artificial Sequence
  CIITA targeting sequence
ggccaagggaggaggaaggg

SEQ ID NO: 53238 - RNA, 20 nt, Artificial Sequence
  CIITA targeting sequence
cuuggccugaguggaggccu

SEQ ID NO: 53239 - RNA, 20 nt, Artificial Sequence
  CIITA targeting sequence
ucccuuggccugaguggagg

SEQ ID NO: 53240 - RNA, 20 nt, Artificial Sequence
  CIITA targeting sequence
uccucccuuggccugagugg

SEQ ID NO: 53241 - RNA, 20 nt, Artificial Sequence
  CIITA targeting sequence
ggcaggagcagcgugagcaa

SEQ ID NO: 53242 - RNA, 20 nt, Artificial Sequence
  CIITA targeting sequence
ugccugagggcccuuccucc

SEQ ID NO: 53243 - RNA, 20 nt, Artificial Sequence
  CIITA targeting sequence
cgcugcuccugccugagggc

SEQ ID NO: 53244 - RNA, 20 nt, Artificial Sequence
  CIITA targeting sequence
ggagcugggacugagcaugg

SEQ ID NO: 53245 - RNA, 20 nt, Artificial Sequence
  CIITA targeting sequence
agaccuuugcucacgcugcu

SEQ ID NO: 53246 - RNA, 20 nt, Artificial Sequence
  CIITA targeting sequence
cagcuccagaccuuugcuca

SEQ ID NO: 53247 - RNA, 20 nt, Artificial Sequence
  CIITA targeting sequence
gucccagcuccagaccuuug

SEQ ID NO: 53248 - RNA, 20 nt, Artificial Sequence
  CIITA targeting sequence
ggagagagagacaagagcuc

SEQ ID NO: 53249 - RNA, 20 nt, Artificial Sequence
  CIITA targeting sequence
ugacaugccaugcucagucc

SEQ ID NO: 53250 - RNA, 20 nt, Artificial Sequence
  CIITA targeting sequence
ccugacaugccaugcucagu

SEQ ID NO: 53251 - RNA, 20 nt, Artificial Sequence
  CIITA targeting sequence
cuccugacaugccaugcuca

SEQ ID NO: 53252 - RNA, 20 nt, Artificial Sequence
  CIITA targeting sequence
cucuccugacaugccaugcu

SEQ ID NO: 53253 - RNA, 20 nt, Artificial Sequence
  CIITA targeting sequence
cucucuccugacaugccaug

SEQ ID NO: 53254 - RNA, 20 nt, Artificial Sequence
  CIITA targeting sequence
ugucucucucuccugacaug

SEQ ID NO: 53255 - RNA, 20 nt, Artificial Sequence
  CIITA targeting sequence
guggccauggggagcagcgu

SEQ ID NO: 53256 - RNA, 20 nt, Artificial Sequence
  CIITA targeting sequence
ccauggccacagagcucuug

SEQ ID NO: 53257 - RNA, 20 nt, Artificial Sequence
  CIITA targeting sequence
cgcugcuccccauggccaca

SEQ ID NO: 53258 - RNA, 20 nt, Artificial Sequence
  CIITA targeting sequence
aaauggagaggcaagaggag

SEQ ID NO: 53259 - RNA, 20 nt, Artificial Sequence
  CIITA targeting sequence
auuuugaccucacgcugcuc

SEQ ID NO: 53260 - RNA, 20 nt, Artificial Sequence
  CIITA targeting sequence
ccauuuugaccucacgcugc

SEQ ID NO: 53261 - RNA, 20 nt, Artificial Sequence
  CIITA targeting sequence
ugccucuccauuuugaccuc

SEQ ID NO: 53262 - RNA, 20 nt, Artificial Sequence
  CIITA targeting sequence
ucuugccucuccauuuugac

SEQ ID NO: 53263 - RNA, 20 nt, Artificial Sequence
  CIITA targeting sequence
cuccucuugccucuccauuu

SEQ ID NO: 53264 - RNA, 20 nt, Artificial Sequence
  CIITA targeting sequence
acaccccucccuccucuugc

SEQ ID NO: 53265 - RNA, 20 nt, Artificial Sequence
  CIITA targeting sequence
cugaaugccagcaugaacgc

SEQ ID NO: 53266 - RNA, 20 nt, Artificial Sequence
  CIITA targeting sequence
gggaccuccacaccccuccc

SEQ ID NO: 53267 - RNA, 20 nt, Artificial Sequence
  CIITA targeting sequence
ugcuggcauucagggaccuc

SEQ ID NO: 53268 - RNA, 20 nt, Artificial Sequence
  CIITA targeting sequence
gggccuucuguggggugggc

SEQ ID NO: 53269 - RNA, 20 nt, Artificial Sequence
  CIITA targeting sequence
guggggugggcggcacggga

SEQ ID NO: 53270 - RNA, 20 nt, Artificial Sequence
  CIITA targeting sequence
cgugccgcccaccccacaga

SEQ ID NO: 53271 - RNA, 20 nt, Artificial Sequence
  CIITA targeting sequence
cccgugccgcccaccccaca

SEQ ID NO: 53272 - RNA, 20 nt, Artificial Sequence
  CIITA targeting sequence
cuuucucccgugccgcccac

SEQ ID NO: 53273 - RNA, 20 nt, Artificial Sequence
  CIITA targeting sequence
agccagcuccggcugggugc

SEQ ID NO: 53274 - RNA, 20 nt, Artificial Sequence
  CIITA targeting sequence
ggcugggugcccuggcucaa

SEQ ID NO: 53275 - RNA, 20 nt, Artificial Sequence
  CIITA targeting sequence
aaccauccuugccucaggca

SEQ ID NO: 53276 - RNA, 20 nt, Artificial Sequence
  CIITA targeting sequence
uugccucaggcaaggacacc

SEQ ID NO: 53277 - RNA, 20 nt, Artificial Sequence
  CIITA targeting sequence
ggcaaggacaccugcaugga

SEQ ID NO: 53278 - RNA, 20 nt, Artificial Sequence
  CIITA targeting sequence
uugccugaggcaaggauggu

SEQ ID NO: 53279 - RNA, 20 nt, Artificial Sequence
  CIITA targeting sequence
augcagguguccuugccuga

SEQ ID NO: 53280 - RNA, 20 nt, Artificial Sequence
  CIITA targeting sequence
cucaagucccaaaccaaguc

SEQ ID NO: 53281 - RNA, 20 nt, Artificial Sequence
  CIITA targeting sequence
agucccaaaccaaguccauc

SEQ ID NO: 53282 - RNA, 20 nt, Artificial Sequence
  CIITA targeting sequence
caaaccaaguccauccuuga

SEQ ID NO: 53283 - RNA, 20 nt, Artificial Sequence
  CIITA targeting sequence
auccuugaguucugucuuug

SEQ ID NO: 53284 - RNA, 20 nt, Artificial Sequence
  CIITA targeting sequence
uugaguucugucuuugucuc

SEQ ID NO: 53285 - RNA, 20 nt, Artificial Sequence
  CIITA targeting sequence
aggauggacuugguuuggga

SEQ ID NO: 53286 - RNA, 20 nt, Artificial Sequence
  CIITA targeting sequence
gucuuugucuccccucaucg

SEQ ID NO: 53287 - RNA, 20 nt, Artificial Sequence
  CIITA targeting sequence
uugucuccccucaucgggcc

SEQ ID NO: 53288 - RNA, 20 nt, Artificial Sequence
  CIITA targeting sequence
ccccucaucgggccgugggg

SEQ ID NO: 53289 - RNA, 20 nt, Artificial Sequence
  CIITA targeting sequence
ccucaucgggccguggggag

SEQ ID NO: 53290 - RNA, 20 nt, Artificial Sequence
  CIITA targeting sequence
ucgggccguggggaguagag

SEQ ID NO: 53291 - RNA, 20 nt, Artificial Sequence
  CIITA targeting sequence
ggccguggggaguagaguga

SEQ ID NO: 53292 - RNA, 20 nt, Artificial Sequence
  CIITA targeting sequence
ccacggcccgaugaggggag

SEQ ID NO: 53293 - RNA, 20 nt, Artificial Sequence
  CIITA targeting sequence
acuccccacggcccgaugag

SEQ ID NO: 53294 - RNA, 20 nt, Artificial Sequence
  CIITA targeting sequence
cucuacuccccacggcccga

SEQ ID NO: 53295 - RNA, 20 nt, Artificial Sequence
  CIITA targeting sequence
uggcuagucucuccacuccu

SEQ ID NO: 53296 - RNA, 20 nt, Artificial Sequence
  CIITA targeting sequence
cuccacuccucugcccccac

SEQ ID NO: 53297 - RNA, 20 nt, Artificial Sequence
  CIITA targeting sequence
ccacuccucugcccccacag

SEQ ID NO: 53298 - RNA, 20 nt, Artificial Sequence
  CIITA targeting sequence
acuccucugcccccacagcc

SEQ ID NO: 53299 - RNA, 20 nt, Artificial Sequence
  CIITA targeting sequence
ucugcccccacagcccaguc

SEQ ID NO: 53300 - RNA, 20 nt, Artificial Sequence
  CIITA targeting sequence
gcccccacagcccagucucc

SEQ ID NO: 53301 - RNA, 20 nt, Artificial Sequence
  CIITA targeting sequence
ccacgcggcggccaggggcg

SEQ ID NO: 53302 - RNA, 20 nt, Artificial Sequence
  CIITA targeting sequence
acgcggcggccaggggcguc

SEQ ID NO: 53303 - RNA, 20 nt, Artificial Sequence
  CIITA targeting sequence
acugaaaacgaaaaucaggu

SEQ ID NO: 53304 - RNA, 20 nt, Artificial Sequence
  CIITA targeting sequence
guagacgccccuggccgccg

SEQ ID NO: 53305 - RNA, 20 nt, Artificial Sequence
  CIITA targeting sequence
uuuucaguagacgccccugg

SEQ ID NO: 53306 - RNA, 20 nt, Artificial Sequence
  CIITA targeting sequence
ggucaugucucucucuuucu

SEQ ID NO: 53307 - RNA, 20 nt, Artificial Sequence
  CIITA targeting sequence
ugucucucucuuucucuuuc

SEQ ID NO: 53308 - RNA, 20 nt, Artificial Sequence
  CIITA targeting sequence
cucucuuucucuuucucucu

SEQ ID NO: 53309 - RNA, 20 nt, Artificial Sequence
  CIITA targeting sequence
cucuuucucuuucucucucu

SEQ ID NO: 53310 - RNA, 20 nt, Artificial Sequence
  CIITA targeting sequence
cuuucucuuucucucucucu

SEQ ID NO: 53311 - RNA, 20 nt, Artificial Sequence
  CIITA targeting sequence
uucucuuucucucucucuuu

SEQ ID NO: 53312 - RNA, 20 nt, Artificial Sequence
  CIITA targeting sequence
cuuucucucucucuuuuuuu

SEQ ID NO: 53313 - RNA, 20 nt, Artificial Sequence
  CIITA targeting sequence
uucucucucucuuuuuuuuu

SEQ ID NO: 53314 - RNA, 20 nt, Artificial Sequence
  CIITA targeting sequence
cucucucuuuuuuuuuuuuu

SEQ ID NO: 53315 - RNA, 20 nt, Artificial Sequence
  CIITA targeting sequence
cucucuuuuuuuuuuuuuga

SEQ ID NO: 53316 - RNA, 20 nt, Artificial Sequence
  CIITA targeting sequence
cucuuuuuuuuuuuuugaga

SEQ ID NO: 53317 - RNA, 20 nt, Artificial Sequence
  CIITA targeting sequence
cuuuuuuuuuuuuugagaug

SEQ ID NO: 53318 - RNA, 20 nt, Artificial Sequence
  CIITA targeting sequence
uuuuuuuuuuuugagaugga

SEQ ID NO: 53319 - RNA, 20 nt, Artificial Sequence
  CIITA targeting sequence
aaaaaaaaaaaagagagaga

SEQ ID NO: 53320 - RNA, 20 nt, Artificial Sequence
  CIITA targeting sequence
caaaaaaaaaaaaagagaga

SEQ ID NO: 53321 - RNA, 20 nt, Artificial Sequence
  CIITA targeting sequence
aucucaaaaaaaaaaaaaga

SEQ ID NO: 53322 - RNA, 20 nt, Artificial Sequence
  CIITA targeting sequence
cccucuguugcgcaggcugg

SEQ ID NO: 53323 - RNA, 20 nt, Artificial Sequence
  CIITA targeting sequence
cucuguugcgcaggcuggag

SEQ ID NO: 53324 - RNA, 20 nt, Artificial Sequence
  CIITA targeting sequence
guugcgcaggcuggagugca

SEQ ID NO: 53325 - RNA, 20 nt, Artificial Sequence
  CIITA targeting sequence
agccugcgcaacagagggag

SEQ ID NO: 53326 - RNA, 20 nt, Artificial Sequence
  CIITA targeting sequence
cgggcucaagugauucuccu

SEQ ID NO: 53327 - RNA, 20 nt, Artificial Sequence
  CIITA targeting sequence
agugauucuccugccccagc

SEQ ID NO: 53328 - RNA, 20 nt, Artificial Sequence
  CIITA targeting sequence
cuugagcccgggaggugguu

SEQ ID NO: 53329 - RNA, 20 nt, Artificial Sequence
  CIITA targeting sequence
ccugccccagccucucaagu

SEQ ID NO: 53330 - RNA, 20 nt, Artificial Sequence
  CIITA targeting sequence
ugccccagccucucaaguag

SEQ ID NO: 53331 - RNA, 20 nt, Artificial Sequence
  CIITA targeting sequence
caaguagauggguuuauagg

SEQ ID NO: 53332 - RNA, 20 nt, Artificial Sequence
  CIITA targeting sequence
aguagauggguuuauaggcc

SEQ ID NO: 53333 - RNA, 20 nt, Artificial Sequence
  CIITA targeting sequence
acuugagaggcuggggcagg

SEQ ID NO: 53334 - RNA, 20 nt, Artificial Sequence
  CIITA targeting sequence
accaaaaauacaaaaauuag

SEQ ID NO: 53335 - RNA, 20 nt, Artificial Sequence
  CIITA targeting sequence
cuaccaaaaauacaaaaauu

SEQ ID NO: 53336 - RNA, 20 nt, Artificial Sequence
  CIITA targeting sequence
aaaccccgucucuaccaaaa

SEQ ID NO: 53337 - RNA, 20 nt, Artificial Sequence
  CIITA targeting sequence
ugaccucaagugauccuccc

SEQ ID NO: 53338 - RNA, 20 nt, Artificial Sequence
  CIITA targeting sequence
ggaaaccagccuggccaaca

SEQ ID NO: 53339 - RNA, 20 nt, Artificial Sequence
  CIITA targeting sequence
agugauccucccacuuuggc

SEQ ID NO: 53340 - RNA, 20 nt, Artificial Sequence
  CIITA targeting sequence
cuugaggucaggaaaccagc

SEQ ID NO: 53341 - RNA, 20 nt, Artificial Sequence
  CIITA targeting sequence
ucccacuuuggcauccuaaa

SEQ ID NO: 53342 - RNA, 20 nt, Artificial Sequence
  CIITA targeting sequence
cacuuuggcauccuaaagug

SEQ ID NO: 53343 - RNA, 20 nt, Artificial Sequence
  CIITA targeting sequence
uaaagugcugagauuacaga

SEQ ID NO: 53344 - RNA, 20 nt, Artificial Sequence
  CIITA targeting sequence
gcacuuuaggaugccaaagu

SEQ ID NO: 53345 - RNA, 20 nt, Artificial Sequence
  CIITA targeting sequence
cagcacuuuaggaugccaaa

SEQ ID NO: 53346 - RNA, 20 nt, Artificial Sequence
  CIITA targeting sequence
guaaucucagcacuuuagga

SEQ ID NO: 53347 - RNA, 20 nt, Artificial Sequence
  CIITA targeting sequence
caucuguaaucucagcacuu

SEQ ID NO: 53348 - RNA, 20 nt, Artificial Sequence
  CIITA targeting sequence
ucucucugucucuccccacc

SEQ ID NO: 53349 - RNA, 20 nt, Artificial Sequence
  CIITA targeting sequence
cucugucucuccccaccccu

SEQ ID NO: 53350 - RNA, 20 nt, Artificial Sequence
  CIITA targeting sequence
cugucucuccccaccccucc

SEQ ID NO: 53351 - RNA, 20 nt, Artificial Sequence
  CIITA targeting sequence
gucucuccccaccccucccc

SEQ ID NO: 53352 - RNA, 20 nt, Artificial Sequence
  CIITA targeting sequence
cuccccaccccuccccucaa

SEQ ID NO: 53353 - RNA, 20 nt, Artificial Sequence
  CIITA targeting sequence
ccccaccccuccccucaaaa

SEQ ID NO: 53354 - RNA, 20 nt, Artificial Sequence
  CIITA targeting sequence
ccaccccuccccucaaaaau

SEQ ID NO: 53355 - RNA, 20 nt, Artificial Sequence
  CIITA targeting sequence
ccucaaaaaugcgcauuccu

SEQ ID NO: 53356 - RNA, 20 nt, Artificial Sequence
  CIITA targeting sequence
aaaaugcgcauuccugguac

SEQ ID NO: 53357 - RNA, 20 nt, Artificial Sequence
  CIITA targeting sequence
ugguacauuuaaagcaaaau

SEQ ID NO: 53358 - RNA, 20 nt, Artificial Sequence
  CIITA targeting sequence
aaauuccuuuaaguggccug

SEQ ID NO: 53359 - RNA, 20 nt, Artificial Sequence
  CIITA targeting sequence
uuuaaguggccugugagucu

SEQ ID NO: 53360 - RNA, 20 nt, Artificial Sequence
  CIITA targeting sequence
caggccacuuaaaggaauuu

SEQ ID NO: 53361 - RNA, 20 nt, Artificial Sequence
  CIITA targeting sequence
cuaccugaucuugccucacc

SEQ ID NO: 53362 - RNA, 20 nt, Artificial Sequence
  CIITA targeting sequence
accugaucuugccucaccga

SEQ ID NO: 53363 - RNA, 20 nt, Artificial Sequence
  CIITA targeting sequence
gguagagacucacaggccac

SEQ ID NO: 53364 - RNA, 20 nt, Artificial Sequence
  CIITA targeting sequence
ugccucaccgaccucuugac

SEQ ID NO: 53365 - RNA, 20 nt, Artificial Sequence
  CIITA targeting sequence
ccgaccucuugacugcauca

SEQ ID NO: 53366 - RNA, 20 nt, Artificial Sequence
  CIITA targeting sequence
gugaggcaagaucagguaga

SEQ ID NO: 53367 - RNA, 20 nt, Artificial Sequence
  CIITA targeting sequence
ugacugcaucacugacugcu

SEQ ID NO: 53368 - RNA, 20 nt, Artificial Sequence
  CIITA targeting sequence
agaggucggugaggcaagau

SEQ ID NO: 53369 - RNA, 20 nt, Artificial Sequence
  CIITA targeting sequence
cugacugcucccccaucacu

SEQ ID NO: 53370 - RNA, 20 nt, Artificial Sequence
  CIITA targeting sequence
gugaugcagucaagaggucg

SEQ ID NO: 53371 - RNA, 20 nt, Artificial Sequence
  CIITA targeting sequence
cccaucacugcgcacccaua

SEQ ID NO: 53372 - RNA, 20 nt, Artificial Sequence
  CIITA targeting sequence
cugcgcacccauacuggccu

SEQ ID NO: 53373 - RNA, 20 nt, Artificial Sequence
  CIITA targeting sequence
guuccucauacacacagggu

SEQ ID NO: 53374 - RNA, 20 nt, Artificial Sequence
  CIITA targeting sequence
ucauacacacagggucgcuc

SEQ ID NO: 53375 - RNA, 20 nt, Artificial Sequence
  CIITA targeting sequence
uacacacagggucgcucccg

SEQ ID NO: 53376 - RNA, 20 nt, Artificial Sequence
  CIITA targeting sequence
cucccgcugcagggccuuag

SEQ ID NO: 53377 - RNA, 20 nt, Artificial Sequence
  CIITA targeting sequence
cgcugcagggccuuagcauu

SEQ ID NO: 53378 - RNA, 20 nt, Artificial Sequence
  CIITA targeting sequence
ccauucccucuggugggagu

SEQ ID NO: 53379 - RNA, 20 nt, Artificial Sequence
  CIITA targeting sequence
cucuggugggaguggcccuu

SEQ ID NO: 53380 - RNA, 20 nt, Artificial Sequence
  CIITA targeting sequence
ggugggaguggcccuucccc

SEQ ID NO: 53381 - RNA, 20 nt, Artificial Sequence
  CIITA targeting sequence
caccagagggaauggcgaau

SEQ ID NO: 53382 - RNA, 20 nt, Artificial Sequence
  CIITA targeting sequence
ccagcccaccagccccuucu

SEQ ID NO: 53383 - RNA, 20 nt, Artificial Sequence
  CIITA targeting sequence
gucauucaggucucagcuga

SEQ ID NO: 53384 - RNA, 20 nt, Artificial Sequence
  CIITA targeting sequence
uucaggucucagcugaggga

SEQ ID NO: 53385 - RNA, 20 nt, Artificial Sequence
  CIITA targeting sequence
ggucucagcugagggagccu

SEQ ID NO: 53386 - RNA, 20 nt, Artificial Sequence
  CIITA targeting sequence
cagcugagggagccugugca

SEQ ID NO: 53387 - RNA, 20 nt, Artificial Sequence
  CIITA targeting sequence
gcugagggagccugugcaga

SEQ ID NO: 53388 - RNA, 20 nt, Artificial Sequence
  CIITA targeting sequence
gcugagaccugaaugacaga

SEQ ID NO: 53389 - RNA, 20 nt, Artificial Sequence
  CIITA targeting sequence
cucagcugagaccugaauga

SEQ ID NO: 53390 - RNA, 20 nt, Artificial Sequence
  CIITA targeting sequence
gcacaggcucccucagcuga

SEQ ID NO: 53391 - RNA, 20 nt, Artificial Sequence
  CIITA targeting sequence
ccccaccccuccugguuuau

SEQ ID NO: 53392 - RNA, 20 nt, Artificial Sequence
  CIITA targeting sequence
ccaccccuccugguuuauuu

SEQ ID NO: 53393 - RNA, 20 nt, Artificial Sequence
  CIITA targeting sequence
ugguuuauuuucuucaucug

SEQ ID NO: 53394 - RNA, 20 nt, Artificial Sequence
  CIITA targeting sequence
ucaucugcaugugcuuagca

SEQ ID NO: 53395 - RNA, 20 nt, Artificial Sequence
  CIITA targeting sequence
ucugcaugugcuuagcaccc

SEQ ID NO: 53396 - RNA, 20 nt, Artificial Sequence
  CIITA targeting sequence
gcaugugcuuagcacccgaa

SEQ ID NO: 53397 - RNA, 20 nt, Artificial Sequence
  CIITA targeting sequence
ggugcuaagcacaugcagau

SEQ ID NO: 53398 - RNA, 20 nt, Artificial Sequence
  CIITA targeting sequence
cuugcucucuccccauccuu

SEQ ID NO: 53399 - RNA, 20 nt, Artificial Sequence
  CIITA targeting sequence
ugcucucuccccauccuuca

SEQ ID NO: 53400 - RNA, 20 nt, Artificial Sequence
  CIITA targeting sequence
cuccccauccuucaccagau

SEQ ID NO: 53401 - RNA, 20 nt, Artificial Sequence
  CIITA targeting sequence
ccccauccuucaccagauua

SEQ ID NO: 53402 - RNA, 20 nt, Artificial Sequence
  CIITA targeting sequence
ccauccuucaccagauuaua

SEQ ID NO: 53403 - RNA, 20 nt, Artificial Sequence
  CIITA targeting sequence
uucaccagauuauaaacucc

SEQ ID NO: 53404 - RNA, 20 nt, Artificial Sequence
  CIITA targeting sequence
ccagauuauaaacuccauaa

SEQ ID NO: 53405 - RNA, 20 nt, Artificial Sequence
  CIITA targeting sequence
ggugaaggauggggagagag

SEQ ID NO: 53406 - RNA, 20 nt, Artificial Sequence
  CIITA targeting sequence
auaaaagcagggucuuuugu

SEQ ID NO: 53407 - RNA, 20 nt, Artificial Sequence
  CIITA targeting sequence
uuuguugguuuuguucaccg

SEQ ID NO: 53408 - RNA, 20 nt, Artificial Sequence
  CIITA targeting sequence
ccgcugcaucccaggcauuc

SEQ ID NO: 53409 - RNA, 20 nt, Artificial Sequence
  CIITA targeting sequence
caggcauucagugagcacuu

SEQ ID NO: 53410 - RNA, 20 nt, Artificial Sequence
  CIITA targeting sequence
gugagcacuuguugagugaa

SEQ ID NO: 53411 - RNA, 20 nt, Artificial Sequence
  CIITA targeting sequence
cugaaugccugggaugcagc

SEQ ID NO: 53412 - RNA, 20 nt, Artificial Sequence
  CIITA targeting sequence
acaagugcucacugaaugcc

SEQ ID NO: 53413 - RNA, 20 nt, Artificial Sequence
  CIITA targeting sequence
cucaacaagugcucacugaa

SEQ ID NO: 53414 - RNA, 20 nt, Artificial Sequence
  CIITA targeting sequence
ucacucaacaagugcucacu

SEQ ID NO: 53415 - RNA, 20 nt, Artificial Sequence
  CIITA targeting sequence
gacucagucuuccccucugu

SEQ ID NO: 53416 - RNA, 20 nt, Artificial Sequence
  CIITA targeting sequence
gauuucuucacucaacaagu

SEQ ID NO: 53417 - RNA, 20 nt, Artificial Sequence
  CIITA targeting sequence
gucuuccccucuguaaaaug

SEQ ID NO: 53418 - RNA, 20 nt, Artificial Sequence
  CIITA targeting sequence
uccccucuguaaaaugggac

SEQ ID NO: 53419 - RNA, 20 nt, Artificial Sequence
  CIITA targeting sequence
ccucuguaaaaugggaccac

SEQ ID NO: 53420 - RNA, 20 nt, Artificial Sequence
  CIITA targeting sequence
guaaaaugggaccacaucaa

SEQ ID NO: 53421 - RNA, 20 nt, Artificial Sequence
  CIITA targeting sequence
cauuuuacagaggggaagac

SEQ ID NO: 53422 - RNA, 20 nt, Artificial Sequence
  CIITA targeting sequence
aaccuccuggcaggguagug

SEQ ID NO: 53423 - RNA, 20 nt, Artificial Sequence
  CIITA targeting sequence
uggcaggguagugguguggc

SEQ ID NO: 53424 - RNA, 20 nt, Artificial Sequence
  CIITA targeting sequence
gagguaacguuuguacacag

SEQ ID NO: 53425 - RNA, 20 nt, Artificial Sequence
  CIITA targeting sequence
gagccacaccacuacccugc

SEQ ID NO: 53426 - RNA, 20 nt, Artificial Sequence
  CIITA targeting sequence
aacuguguacaaacguuacc

SEQ ID NO: 53427 - RNA, 20 nt, Artificial Sequence
  CIITA targeting sequence
ucccuacuggcccaaggacu

SEQ ID NO: 53428 - RNA, 20 nt, Artificial Sequence
  CIITA targeting sequence
cuacuggcccaaggacuuac

SEQ ID NO: 53429 - RNA, 20 nt, Artificial Sequence
  CIITA targeting sequence
uugggccaguagggaagaag

SEQ ID NO: 53430 - RNA, 20 nt, Artificial Sequence
  CIITA targeting sequence
uggaacccagccuccuccag

SEQ ID NO: 53431 - RNA, 20 nt, Artificial Sequence
  CIITA targeting sequence
aggagggguggccagguaag

SEQ ID NO: 53432 - RNA, 20 nt, Artificial Sequence
  CIITA targeting sequence
uccagcucccccaagcccuc

SEQ ID NO: 53433 - RNA, 20 nt, Artificial Sequence
  CIITA targeting sequence
agcucccccaagcccucugc

SEQ ID NO: 53434 - RNA, 20 nt, Artificial Sequence
  CIITA targeting sequence
cccaagcccucugccuuggg

SEQ ID NO: 53435 - RNA, 20 nt, Artificial Sequence
  CIITA targeting sequence
gccuugggagcggacaccuu

SEQ ID NO: 53436 - RNA, 20 nt, Artificial Sequence
  CIITA targeting sequence
caaggcagagggcuuggggg

SEQ ID NO: 53437 - RNA, 20 nt, Artificial Sequence
  CIITA targeting sequence
gcucccaaggcagagggcuu

SEQ ID NO: 53438 - RNA, 20 nt, Artificial Sequence
  CIITA targeting sequence
gcuaagguguccgcucccaa

SEQ ID NO: 53439 - RNA, 20 nt, Artificial Sequence
  CIITA targeting sequence
uccagacccuuugcagccag

SEQ ID NO: 53440 - RNA, 20 nt, Artificial Sequence
  CIITA targeting sequence
agacccuuugcagccaggcc

SEQ ID NO: 53441 - RNA, 20 nt, Artificial Sequence
  CIITA targeting sequence
ggaggacggcccuucugcua

SEQ ID NO: 53442 - RNA, 20 nt, Artificial Sequence
  CIITA targeting sequence
cugcucacagaucccugagg

SEQ ID NO: 53443 - RNA, 20 nt, Artificial Sequence
  CIITA targeting sequence
gcucacagaucccugaggac

SEQ ID NO: 53444 - RNA, 20 nt, Artificial Sequence
  CIITA targeting sequence
cagaucccugaggacauccg

SEQ ID NO: 53445 - RNA, 20 nt, Artificial Sequence
  CIITA targeting sequence
gugagcagagaggccuggcu

SEQ ID NO: 53446 - RNA, 20 nt, Artificial Sequence
  CIITA targeting sequence
cugaggacauccggagguug

SEQ ID NO: 53447 - RNA, 20 nt, Artificial Sequence
  CIITA targeting sequence
gggaucugugagcagagagg

SEQ ID NO: 53448 - RNA, 20 nt, Artificial Sequence
  CIITA targeting sequence
ucagggaucugugagcagag

SEQ ID NO: 53449 - RNA, 20 nt, Artificial Sequence
  CIITA targeting sequence
ggagguuggugcccagagcc

SEQ ID NO: 53450 - RNA, 20 nt, Artificial Sequence
  CIITA targeting sequence
ggauguccucagggaucugu

SEQ ID NO: 53451 - RNA, 20 nt, Artificial Sequence
  CIITA targeting sequence
gggcaccaaccuccggaugu

SEQ ID NO: 53452 - RNA, 20 nt, Artificial Sequence
  CIITA targeting sequence
ugcaaauucugucuuccagu

SEQ ID NO: 53453 - RNA, 20 nt, Artificial Sequence
  CIITA targeting sequence
gucuuccaguucagcagcug

SEQ ID NO: 53454 - RNA, 20 nt, Artificial Sequence
  CIITA targeting sequence
uccaguucagcagcuguggc

SEQ ID NO: 53455 - RNA, 20 nt, Artificial Sequence
  CIITA targeting sequence
aguucagcagcuguggccuc

SEQ ID NO: 53456 - RNA, 20 nt, Artificial Sequence
  CIITA targeting sequence
gcagcuguggccuccuucac

SEQ ID NO: 53457 - RNA, 20 nt, Artificial Sequence
  CIITA targeting sequence
uucacucggccuuuuaaaag

SEQ ID NO: 53458 - RNA, 20 nt, Artificial Sequence
  CIITA targeting sequence
cucggccuuuuaaaagaaau

SEQ ID NO: 53459 - RNA, 20 nt, Artificial Sequence
  CIITA targeting sequence
gccuuuuaaaagaaauucuu

SEQ ID NO: 53460 - RNA, 20 nt, Artificial Sequence
  CIITA targeting sequence
uuuaaaaggccgagugaagg

SEQ ID NO: 53461 - RNA, 20 nt, Artificial Sequence
  CIITA targeting sequence
ugggcugacucacacuuccu

SEQ ID NO: 53462 - RNA, 20 nt, Artificial Sequence
  CIITA targeting sequence
gcccaagaauuucuuuuaaa

SEQ ID NO: 53463 - RNA, 20 nt, Artificial Sequence
  CIITA targeting sequence
cacuuccuuugucuccagcu

SEQ ID NO: 53464 - RNA, 20 nt, Artificial Sequence
  CIITA targeting sequence
uuugucuccagcuggguuca

SEQ ID NO: 53465 - RNA, 20 nt, Artificial Sequence
  CIITA targeting sequence
ccagcuggguucacucaagu

SEQ ID NO: 53466 - RNA, 20 nt, Artificial Sequence
  CIITA targeting sequence
agcuggguucacucaagugu

SEQ ID NO: 53467 - RNA, 20 nt, Artificial Sequence
  CIITA targeting sequence
cucaagugucgcuguuuugc

SEQ ID NO: 53468 - RNA, 20 nt, Artificial Sequence
  CIITA targeting sequence
agugucgcuguuuugcaagg

SEQ ID NO: 53469 - RNA, 20 nt, Artificial Sequence
  CIITA targeting sequence
cuguuuugcaaggcugaggu

SEQ ID NO: 53470 - RNA, 20 nt, Artificial Sequence
  CIITA targeting sequence
gccuugcaaaacagcgacac

SEQ ID NO: 53471 - RNA, 20 nt, Artificial Sequence
  CIITA targeting sequence
aaccucagccuugcaaaaca

SEQ ID NO: 53472 - RNA, 20 nt, Artificial Sequence
  CIITA targeting sequence
cucagaagcaaucucugaug

SEQ ID NO: 53473 - RNA, 20 nt, Artificial Sequence
  CIITA targeting sequence
gaagcaaucucugaugcagg

SEQ ID NO: 53474 - RNA, 20 nt, Artificial Sequence
  CIITA targeting sequence
gagggacucaaaccucagcc

SEQ ID NO: 53475 - RNA, 20 nt, Artificial Sequence
  CIITA targeting sequence
cugaugcaggggcgcugugu

SEQ ID NO: 53476 - RNA, 20 nt, Artificial Sequence
  CIITA targeting sequence
gaugcaggggcgcugugugc

SEQ ID NO: 53477 - RNA, 20 nt, Artificial Sequence
  CIITA targeting sequence
gagauugcuucugagggacu

SEQ ID NO: 53478 - RNA, 20 nt, Artificial Sequence
  CIITA targeting sequence
uugaacuucgaaugaagguc

SEQ ID NO: 53479 - RNA, 20 nt, Artificial Sequence
  CIITA targeting sequence
augaagcacacagcgccccu

SEQ ID NO: 53480 - RNA, 20 nt, Artificial Sequence
  CIITA targeting sequence
aaugaaggucaggcccccca

SEQ ID NO: 53481 - RNA, 20 nt, Artificial Sequence
  CIITA targeting sequence
aaguucaaugaagcacacag

SEQ ID NO: 53482 - RNA, 20 nt, Artificial Sequence
  CIITA targeting sequence
uucgaaguucaaugaagcac

SEQ ID NO: 53483 - RNA, 20 nt, Artificial Sequence
  CIITA targeting sequence
ggccccccagaaaaccucau

SEQ ID NO: 53484 - RNA, 20 nt, Artificial Sequence
  CIITA targeting sequence
ggggggccugaccuucauuc

SEQ ID NO: 53485 - RNA, 20 nt, Artificial Sequence
  CIITA targeting sequence
uaccaggacaguugggaaac

SEQ ID NO: 53486 - RNA, 20 nt, Artificial Sequence
  CIITA targeting sequence
ugguaugagguuuucugggg

SEQ ID NO: 53487 - RNA, 20 nt, Artificial Sequence
  CIITA targeting sequence
caacuguccugguaugaggu

SEQ ID NO: 53488 - RNA, 20 nt, Artificial Sequence
  CIITA targeting sequence
cugguggucagggcauucug

SEQ ID NO: 53489 - RNA, 20 nt, Artificial Sequence
  CIITA targeting sequence
gggcauucuggguuggagaa

SEQ ID NO: 53490 - RNA, 20 nt, Artificial Sequence
  CIITA targeting sequence
ggguuggagaaacugcuuug

SEQ ID NO: 53491 - RNA, 20 nt, Artificial Sequence
  CIITA targeting sequence
aacccagaaugcccugacca

SEQ ID NO: 53492 - RNA, 20 nt, Artificial Sequence
  CIITA targeting sequence
ccaacccagaaugcccugac

SEQ ID NO: 53493 - RNA, 20 nt, Artificial Sequence
  CIITA targeting sequence
uuuuguccaucccccugccu

SEQ ID NO: 53494 - RNA, 20 nt, Artificial Sequence
  CIITA targeting sequence
aucccccugccucccaccua

SEQ ID NO: 53495 - RNA, 20 nt, Artificial Sequence
  CIITA targeting sequence
cccugccucccaccuaaccc

SEQ ID NO: 53496 - RNA, 20 nt, Artificial Sequence
  CIITA targeting sequence
caccuaaccccaucccaaac

SEQ ID NO: 53497 - RNA, 20 nt, Artificial Sequence
  CIITA targeting sequence
caaacucacucaaaaaaaug

SEQ ID NO: 53498 - RNA, 20 nt, Artificial Sequence
  CIITA targeting sequence
cucaaaaaaaugccccuacu

SEQ ID NO: 53499 - RNA, 20 nt, Artificial Sequence
  CIITA targeting sequence
aaaaaaugccccuacugccc

SEQ ID NO: 53500 - RNA, 20 nt, Artificial Sequence
  CIITA targeting sequence
acgucucauguaccccgcuu

SEQ ID NO: 53501 - RNA, 20 nt, Artificial Sequence
  CIITA targeting sequence
cauguaccccgcuuuuccuu

SEQ ID NO: 53502 - RNA, 20 nt, Artificial Sequence
  CIITA targeting sequence
uguaccccgcuuuuccuucc

SEQ ID NO: 53503 - RNA, 20 nt, Artificial Sequence
  CIITA targeting sequence
uuccuucccugugaaaucag

SEQ ID NO: 53504 - RNA, 20 nt, Artificial Sequence
  CIITA targeting sequence
uucccugugaaaucaggcgu

SEQ ID NO: 53505 - RNA, 20 nt, Artificial Sequence
  CIITA targeting sequence
cugugaaaucaggcguuugg

SEQ ID NO: 53506 - RNA, 20 nt, Artificial Sequence
  CIITA targeting sequence
cagggaaggaaggaaaagcg

SEQ ID NO: 53507 - RNA, 20 nt, Artificial Sequence
  CIITA targeting sequence
ggcguuuggauucagcgcac

SEQ ID NO: 53508 - RNA, 20 nt, Artificial Sequence
  CIITA targeting sequence
aaacgccugauuucacaggg

SEQ ID NO: 53509 - RNA, 20 nt, Artificial Sequence
  CIITA targeting sequence
gcgcacugcucagaagguuu

SEQ ID NO: 53510 - RNA, 20 nt, Artificial Sequence
  CIITA targeting sequence
gaagguuuguuucuuucugu

SEQ ID NO: 53511 - RNA, 20 nt, Artificial Sequence
  CIITA targeting sequence
gagcagugcgcugaauccaa

SEQ ID NO: 53512 - RNA, 20 nt, Artificial Sequence
  CIITA targeting sequence
uucugugcaaacacguggag

SEQ ID NO: 53513 - RNA, 20 nt, Artificial Sequence
  CIITA targeting sequence
gugcaaacacguggagugau

SEQ ID NO: 53514 - RNA, 20 nt, Artificial Sequence
  CIITA targeting sequence
acguguuugcacagaaagaa

SEQ ID NO: 53515 - RNA, 20 nt, Artificial Sequence
  CIITA targeting sequence
cuccacguguuugcacagaa

SEQ ID NO: 53516 - RNA, 20 nt, Artificial Sequence
  CIITA targeting sequence
gucucgauuuucuagaacac

SEQ ID NO: 53517 - RNA, 20 nt, Artificial Sequence
  CIITA targeting sequence
cgauuuucuagaacacuucc

SEQ ID NO: 53518 - RNA, 20 nt, Artificial Sequence
  CIITA targeting sequence
auuuucuagaacacuuccac

SEQ ID NO: 53519 - RNA, 20 nt, Artificial Sequence
  CIITA targeting sequence
agacagagcaucacuccacg

SEQ ID NO: 53520 - RNA, 20 nt, Artificial Sequence
  CIITA targeting sequence
agaacacuuccacuuucaca

SEQ ID NO: 53521 - RNA, 20 nt, Artificial Sequence
  CIITA targeting sequence
agaaaaucgagacagagcau

SEQ ID NO: 53522 - RNA, 20 nt, Artificial Sequence
  CIITA targeting sequence
acuuucacagaauugcgguu

SEQ ID NO: 53523 - RNA, 20 nt, Artificial Sequence
  CIITA targeting sequence
cagaauugcgguuauuuuga

SEQ ID NO: 53524 - RNA, 20 nt, Artificial Sequence
  CIITA targeting sequence
gugaaaguggaaguguucua

SEQ ID NO: 53525 - RNA, 20 nt, Artificial Sequence
  CIITA targeting sequence
aaauaaccgcaauucuguga

SEQ ID NO: 53526 - RNA, 20 nt, Artificial Sequence
  CIITA targeting sequence
caaaauaaccgcaauucugu

SEQ ID NO: 53527 - RNA, 20 nt, Artificial Sequence
  CIITA targeting sequence
guuacagguacaacaauaua

SEQ ID NO: 53528 - RNA, 20 nt, Artificial Sequence
  CIITA targeting sequence
gcauuucuuguuucuguccc

SEQ ID NO: 53529 - RNA, 20 nt, Artificial Sequence
  CIITA targeting sequence
uguuucugucccuggaagag

SEQ ID NO: 53530 - RNA, 20 nt, Artificial Sequence
  CIITA targeting sequence
gucccuggaagaguuuuuau

SEQ ID NO: 53531 - RNA, 20 nt, Artificial Sequence
  CIITA targeting sequence
cuggaagaguuuuuauguaa

SEQ ID NO: 53532 - RNA, 20 nt, Artificial Sequence
  CIITA targeting sequence
agggacagaaacaagaaaug

SEQ ID NO: 53533 - RNA, 20 nt, Artificial Sequence
  CIITA targeting sequence
uccagggacagaaacaagaa

SEQ ID NO: 53534 - RNA, 20 nt, Artificial Sequence
  CIITA targeting sequence
cacugcuccaggggaaagga

SEQ ID NO: 53535 - RNA, 20 nt, Artificial Sequence
  CIITA targeting sequence
aggggaaaggaauuccugag

SEQ ID NO: 53536 - RNA, 20 nt, Artificial Sequence
  CIITA targeting sequence
ccuggagcagugugacuuua

SEQ ID NO: 53537 - RNA, 20 nt, Artificial Sequence
  CIITA targeting sequence
uuuccccuggagcaguguga

SEQ ID NO: 53538 - RNA, 20 nt, Artificial Sequence
  CIITA targeting sequence
ugaggaauucccuggagaga

SEQ ID NO: 53539 - RNA, 20 nt, Artificial Sequence
  CIITA targeting sequence
ggaauuccuuuccccuggag

SEQ ID NO: 53540 - RNA, 20 nt, Artificial Sequence
  CIITA targeting sequence
ucaggaauuccuuuccccug

SEQ ID NO: 53541 - RNA, 20 nt, Artificial Sequence
  CIITA targeting sequence
cuggagagaaagggaugagu

SEQ ID NO: 53542 - RNA, 20 nt, Artificial Sequence
  CIITA targeting sequence
agggaauuccucaggaauuc

SEQ ID NO: 53543 - RNA, 20 nt, Artificial Sequence
  CIITA targeting sequence
ccagggaauuccucaggaau

SEQ ID NO: 53544 - RNA, 20 nt, Artificial Sequence
  CIITA targeting sequence
cuccagggaauuccucagga

SEQ ID NO: 53545 - RNA, 20 nt, Artificial Sequence
  CIITA targeting sequence
cuuucucuccagggaauucc

SEQ ID NO: 53546 - RNA, 20 nt, Artificial Sequence
  CIITA targeting sequence
ucccuuucucuccagggaau

SEQ ID NO: 53547 - RNA, 20 nt, Artificial Sequence
  CIITA targeting sequence
cucaucccuuucucuccagg

SEQ ID NO: 53548 - RNA, 20 nt, Artificial Sequence
  CIITA targeting sequence
cccgucuccaguagaaagaa

SEQ ID NO: 53549 - RNA, 20 nt, Artificial Sequence
  CIITA targeting sequence
cgucuccaguagaaagaacu

SEQ ID NO: 53550 - RNA, 20 nt, Artificial Sequence
  CIITA targeting sequence
ccaguagaaagaacuggagc

SEQ ID NO: 53551 - RNA, 20 nt, Artificial Sequence
  CIITA targeting sequence
aguagaaagaacuggagcuu

SEQ ID NO: 53552 - RNA, 20 nt, Artificial Sequence
  CIITA targeting sequence
acuggagacgggagaaaaug

SEQ ID NO: 53553 - RNA, 20 nt, Artificial Sequence
  CIITA targeting sequence
uucuacuggagacgggagaa

SEQ ID NO: 53554 - RNA, 20 nt, Artificial Sequence
  CIITA targeting sequence
aguucuuucuacuggagacg

SEQ ID NO: 53555 - RNA, 20 nt, Artificial Sequence
  CIITA targeting sequence
aaagcuccaguucuuucuac

SEQ ID NO: 53556 - RNA, 20 nt, Artificial Sequence
  CIITA targeting sequence
gccugccuccaaagcuccag

SEQ ID NO: 53557 - RNA, 20 nt, Artificial Sequence
  CIITA targeting sequence
gggucaaccucuuccuggcu

SEQ ID NO: 53558 - RNA, 20 nt, Artificial Sequence
  CIITA targeting sequence
accucuuccuggcugugagg

SEQ ID NO: 53559 - RNA, 20 nt, Artificial Sequence
  CIITA targeting sequence
uccuggcugugaggcauuga

SEQ ID NO: 53560 - RNA, 20 nt, Artificial Sequence
  CIITA targeting sequence
uggcugugaggcauugagua

SEQ ID NO: 53561 - RNA, 20 nt, Artificial Sequence
  CIITA targeting sequence
cagccaggaagagguugacc

SEQ ID NO: 53562 - RNA, 20 nt, Artificial Sequence
  CIITA targeting sequence
augccucacagccaggaaga

SEQ ID NO: 53563 - RNA, 20 nt, Artificial Sequence
  CIITA targeting sequence
caaagggccugaauuucuug

SEQ ID NO: 53564 - RNA, 20 nt, Artificial Sequence
  CIITA targeting sequence
aagggccugaauuucuuggg

SEQ ID NO: 53565 - RNA, 20 nt, Artificial Sequence
  CIITA targeting sequence
ggcccuuugagagguuaagu

SEQ ID NO: 53566 - RNA, 20 nt, Artificial Sequence
  CIITA targeting sequence
uggggguagauuuagggcac

SEQ ID NO: 53567 - RNA, 20 nt, Artificial Sequence
  CIITA targeting sequence
acccccaagaaauucaggcc

SEQ ID NO: 53568 - RNA, 20 nt, Artificial Sequence
  CIITA targeting sequence
cuggauacuauuuuugaggg

SEQ ID NO: 53569 - RNA, 20 nt, Artificial Sequence
  CIITA targeting sequence
agggauaacugugcccuaaa

SEQ ID NO: 53570 - RNA, 20 nt, Artificial Sequence
  CIITA targeting sequence
aaaauaguauccagggauaa

SEQ ID NO: 53571 - RNA, 20 nt, Artificial Sequence
  CIITA targeting sequence
ccccucaaaaauaguaucca

SEQ ID NO: 53572 - RNA, 20 nt, Artificial Sequence
  CIITA targeting sequence
aaccuuuuuuauuuacuuau

SEQ ID NO: 53573 - RNA, 20 nt, Artificial Sequence
  CIITA targeting sequence
acuccccccucaaaaauagu

SEQ ID NO: 53574 - RNA, 20 nt, Artificial Sequence
  CIITA targeting sequence
aaaaaaaauaaguaaauaaa

SEQ ID NO: 53575 - RNA, 20 nt, Artificial Sequence
  CIITA targeting sequence
cuaaaaaaaauaaguaaaua

SEQ ID NO: 53576 - RNA, 20 nt, Artificial Sequence
  CIITA targeting sequence
ugcucugucauccaagcugc

SEQ ID NO: 53577 - RNA, 20 nt, Artificial Sequence
  CIITA targeting sequence
gucauccaagcugcagugca

SEQ ID NO: 53578 - RNA, 20 nt, Artificial Sequence
  CIITA targeting sequence
uccaagcugcagugcagugg

SEQ ID NO: 53579 - RNA, 20 nt, Artificial Sequence
  CIITA targeting sequence
aagcugcagugcaguggcau

SEQ ID NO: 53580 - RNA, 20 nt, Artificial Sequence
  CIITA targeting sequence
ugccacugcacugcagcuug

SEQ ID NO: 53581 - RNA, 20 nt, Artificial Sequence
  CIITA targeting sequence
cagcucacugcagccucgac

SEQ ID NO: 53582 - RNA, 20 nt, Artificial Sequence
  CIITA targeting sequence
cugcagccucgacuuccuag

SEQ ID NO: 53583 - RNA, 20 nt, Artificial Sequence
  CIITA targeting sequence
acuuccuaggcucaagugau

SEQ ID NO: 53584 - RNA, 20 nt, Artificial Sequence
  CIITA targeting sequence
aggcugcagugagcugugau

SEQ ID NO: 53585 - RNA, 20 nt, Artificial Sequence
  CIITA targeting sequence
uaggcucaagugauccuacc

SEQ ID NO: 53586 - RNA, 20 nt, Artificial Sequence
  CIITA targeting sequence
agugauccuaccaccucagc

SEQ ID NO: 53587 - RNA, 20 nt, Artificial Sequence
  CIITA targeting sequence
cuugagccuaggaagucgag

SEQ ID NO: 53588 - RNA, 20 nt, Artificial Sequence
  CIITA targeting sequence
uaccaccucagccucccaag

SEQ ID NO: 53589 - RNA, 20 nt, Artificial Sequence
  CIITA targeting sequence
gccucccaaguagcugggac

SEQ ID NO: 53590 - RNA, 20 nt, Artificial Sequence
  CIITA targeting sequence
caaguagcugggacuacagg

SEQ ID NO: 53591 - RNA, 20 nt, Artificial Sequence
  CIITA targeting sequence
cagcuacuugggaggcugag

SEQ ID NO: 53592 - RNA, 20 nt, Artificial Sequence
  CIITA targeting sequence
acaaaaaauuaaaaaauuag

SEQ ID NO: 53593 - RNA, 20 nt, Artificial Sequence
  CIITA targeting sequence
cuacaaaaaauuaaaaaauu

SEQ ID NO: 53594 - RNA, 20 nt, Artificial Sequence
  CIITA targeting sequence
cccuguuacccagccugguc

SEQ ID NO: 53595 - RNA, 20 nt, Artificial Sequence
  CIITA targeting sequence
cuguuacccagccuggucuu

SEQ ID NO: 53596 - RNA, 20 nt, Artificial Sequence
  CIITA targeting sequence
ugaacuccugggcucaagcg

SEQ ID NO: 53597 - RNA, 20 nt, Artificial Sequence
  CIITA targeting sequence
agaccaggcuggguaacagg

SEQ ID NO: 53598 - RNA, 20 nt, Artificial Sequence
  CIITA targeting sequence
ugggcucaagcgauccuccc

SEQ ID NO: 53599 - RNA, 20 nt, Artificial Sequence
  CIITA targeting sequence
agcgauccucccgcuuuggc

SEQ ID NO: 53600 - RNA, 20 nt, Artificial Sequence
  CIITA targeting sequence
cuugagcccaggaguucaag

SEQ ID NO: 53601 - RNA, 20 nt, Artificial Sequence
  CIITA targeting sequence
ucccgcuuuggccucccaaa

SEQ ID NO: 53602 - RNA, 20 nt, Artificial Sequence
  CIITA targeting sequence
cgcuuuggccucccaaaaug

SEQ ID NO: 53603 - RNA, 20 nt, Artificial Sequence
  CIITA targeting sequence
caaaauguugggauuauagg

SEQ ID NO: 53604 - RNA, 20 nt, Artificial Sequence
  CIITA targeting sequence
caacauuuugggaggccaaa

SEQ ID NO: 53605 - RNA, 20 nt, Artificial Sequence
  CIITA targeting sequence
cgccuauaaucccaacauuu

SEQ ID NO: 53606 - RNA, 20 nt, Artificial Sequence
  CIITA targeting sequence
aggccaggcucacgccuaua

SEQ ID NO: 53607 - RNA, 20 nt, Artificial Sequence
  CIITA targeting sequence
auuuauuaaaaauagguucc

SEQ ID NO: 53608 - RNA, 20 nt, Artificial Sequence
  CIITA targeting sequence
cuuccauuuauuaaaaauag

SEQ ID NO: 53609 - RNA, 20 nt, Artificial Sequence
  CIITA targeting sequence
cguaacauaaaauuaacuaa

SEQ ID NO: 53610 - RNA, 20 nt, Artificial Sequence
  CIITA targeting sequence
aauuaguuaauuuuauguua

SEQ ID NO: 53611 - RNA, 20 nt, Artificial Sequence
  CIITA targeting sequence
uuucaaauuaguuaauuuua

SEQ ID NO: 53612 - RNA, 20 nt, Artificial Sequence
  CIITA targeting sequence
guggugcuuaguacauuuac

SEQ ID NO: 53613 - RNA, 20 nt, Artificial Sequence
  CIITA targeting sequence
cuuuaguuggaaaacauuuu

SEQ ID NO: 53614 - RNA, 20 nt, Artificial Sequence
  CIITA targeting sequence
uuaguuggaaaacauuuuca

SEQ ID NO: 53615 - RNA, 20 nt, Artificial Sequence
  CIITA targeting sequence
aacuaaagagaggugguagu

SEQ ID NO: 53616 - RNA, 20 nt, Artificial Sequence
  CIITA targeting sequence
ucauucccaaaggaaacucu

SEQ ID NO: 53617 - RNA, 20 nt, Artificial Sequence
  CIITA targeting sequence
uucccaaaggaaacucugua

SEQ ID NO: 53618 - RNA, 20 nt, Artificial Sequence
  CIITA targeting sequence
caaaggaaacucuguaucca

SEQ ID NO: 53619 - RNA, 20 nt, Artificial Sequence
  CIITA targeting sequence
uuugggaaugaugaaaaugu

SEQ ID NO: 53620 - RNA, 20 nt, Artificial Sequence
  CIITA targeting sequence
guauccauuaagcagucauu

SEQ ID NO: 53621 - RNA, 20 nt, Artificial Sequence
  CIITA targeting sequence
auuaagcagucauucucuac

SEQ ID NO: 53622 - RNA, 20 nt, Artificial Sequence
  CIITA targeting sequence
uucucuacucccucuucucc

SEQ ID NO: 53623 - RNA, 20 nt, Artificial Sequence
  CIITA targeting sequence
cuacucccucuucuccuugg

SEQ ID NO: 53624 - RNA, 20 nt, Artificial Sequence
  CIITA targeting sequence
acucccucuucuccuuggua

SEQ ID NO: 53625 - RNA, 20 nt, Artificial Sequence
  CIITA targeting sequence
cucuucuccuugguaguuaa

SEQ ID NO: 53626 - RNA, 20 nt, Artificial Sequence
  CIITA targeting sequence
ucuccuugguaguuaacuua

SEQ ID NO: 53627 - RNA, 20 nt, Artificial Sequence
  CIITA targeting sequence
ccuugguaguuaacuuaggu

SEQ ID NO: 53628 - RNA, 20 nt, Artificial Sequence
  CIITA targeting sequence
uugguaguuaacuuagguac

SEQ ID NO: 53629 - RNA, 20 nt, Artificial Sequence
  CIITA targeting sequence
ugacugaagucccugaagaa

SEQ ID NO: 53630 - RNA, 20 nt, Artificial Sequence
  CIITA targeting sequence
agaaagcccaguaguaccua

SEQ ID NO: 53631 - RNA, 20 nt, Artificial Sequence
  CIITA targeting sequence
gucaagaaagcccaguagua

SEQ ID NO: 53632 - RNA, 20 nt, Artificial Sequence
  CIITA targeting sequence
cugaagaagaaacaaauauu

SEQ ID NO: 53633 - RNA, 20 nt, Artificial Sequence
  CIITA targeting sequence
gggacuucagucaagaaagc

SEQ ID NO: 53634 - RNA, 20 nt, Artificial Sequence
  CIITA targeting sequence
ucagggacuucagucaagaa

SEQ ID NO: 53635 - RNA, 20 nt, Artificial Sequence
  CIITA targeting sequence
ucuucagggacuucagucaa

SEQ ID NO: 53636 - RNA, 20 nt, Artificial Sequence
  CIITA targeting sequence
agcugggccaccaccuguga

SEQ ID NO: 53637 - RNA, 20 nt, Artificial Sequence
  CIITA targeting sequence
caggugguggcccagcugga

SEQ ID NO: 53638 - RNA, 20 nt, Artificial Sequence
  CIITA targeting sequence
uuugcacggggcugggauuc

SEQ ID NO: 53639 - RNA, 20 nt, Artificial Sequence
  CIITA targeting sequence
cagccccgugcaaaugacaa

SEQ ID NO: 53640 - RNA, 20 nt, Artificial Sequence
  CIITA targeting sequence
guucuggguauguaugugcc

SEQ ID NO: 53641 - RNA, 20 nt, Artificial Sequence
  CIITA targeting sequence
ggguauguaugugccauucu

SEQ ID NO: 53642 - RNA, 20 nt, Artificial Sequence
  CIITA targeting sequence
auauauauguguguguguau

SEQ ID NO: 53643 - RNA, 20 nt, Artificial Sequence
  CIITA targeting sequence
gcauuaaaaaaaaaaaaaaa

SEQ ID NO: 53644 - RNA, 20 nt, Artificial Sequence
  CIITA targeting sequence
cugcauuaaaaaaaaaaaaa

SEQ ID NO: 53645 - RNA, 20 nt, Artificial Sequence
  CIITA targeting sequence
cucuguugaccgggcuggag

SEQ ID NO: 53646 - RNA, 20 nt, Artificial Sequence
  CIITA targeting sequence
guugaccgggcuggagugua

SEQ ID NO: 53647 - RNA, 20 nt, Artificial Sequence
  CIITA targeting sequence
acagagugagucucugcauu

SEQ ID NO: 53648 - RNA, 20 nt, Artificial Sequence
  CIITA targeting sequence
agcccggucaacagagugag

SEQ ID NO: 53649 - RNA, 20 nt, Artificial Sequence
  CIITA targeting sequence
ugccacuacacuccagcccg

SEQ ID NO: 53650 - RNA, 20 nt, Artificial Sequence
  CIITA targeting sequence
cagcucauugcuaccuccgc

SEQ ID NO: 53651 - RNA, 20 nt, Artificial Sequence
  CIITA targeting sequence
gcucauugcuaccuccgccu

SEQ ID NO: 53652 - RNA, 20 nt, Artificial Sequence
  CIITA targeting sequence
uugcuaccuccgccucccag

SEQ ID NO: 53653 - RNA, 20 nt, Artificial Sequence
  CIITA targeting sequence
gccucccagguucaagcgau

SEQ ID NO: 53654 - RNA, 20 nt, Artificial Sequence
  CIITA targeting sequence
cagguucaagcgauucuccc

SEQ ID NO: 53655 - RNA, 20 nt, Artificial Sequence
  CIITA targeting sequence
agcgauucucccaccuuagc

SEQ ID NO: 53656 - RNA, 20 nt, Artificial Sequence
  CIITA targeting sequence
cuugaaccugggaggcggag

SEQ ID NO: 53657 - RNA, 20 nt, Artificial Sequence
  CIITA targeting sequence
cccaccuuagccuccuaagu

SEQ ID NO: 53658 - RNA, 20 nt, Artificial Sequence
  CIITA targeting sequence
caccuuagccuccuaaguag

SEQ ID NO: 53659 - RNA, 20 nt, Artificial Sequence
  CIITA targeting sequence
uaaguagcugggacuacaug

SEQ ID NO: 53660 - RNA, 20 nt, Artificial Sequence
  CIITA targeting sequence
cagcuacuuaggaggcuaag

SEQ ID NO: 53661 - RNA, 20 nt, Artificial Sequence
  CIITA targeting sequence
accaccaugccuggcuaagu

SEQ ID NO: 53662 - RNA, 20 nt, Artificial Sequence
  CIITA targeting sequence
aaaaaauacaaaacuuagcc

SEQ ID NO: 53663 - RNA, 20 nt, Artificial Sequence
  CIITA targeting sequence
uccaaaaaauacaaaacuua

SEQ ID NO: 53664 - RNA, 20 nt, Artificial Sequence
  CIITA targeting sequence
cuuccaaaaaauacaaaacu

SEQ ID NO: 53665 - RNA, 20 nt, Artificial Sequence
  CIITA targeting sequence
cgaacucuugaccucaagug

SEQ ID NO: 53666 - RNA, 20 nt, Artificial Sequence
  CIITA targeting sequence
aacucuugaccucaagugau

SEQ ID NO: 53667 - RNA, 20 nt, Artificial Sequence
  CIITA targeting sequence
agauuagccuggccaacaug

SEQ ID NO: 53668 - RNA, 20 nt, Artificial Sequence
  CIITA targeting sequence
ugaccucaagugauccaccc

SEQ ID NO: 53669 - RNA, 20 nt, Artificial Sequence
  CIITA targeting sequence
agaguucgagauuagccugg

SEQ ID NO: 53670 - RNA, 20 nt, Artificial Sequence
  CIITA targeting sequence
agugauccacccaccucagc

SEQ ID NO: 53671 - RNA, 20 nt, Artificial Sequence
  CIITA targeting sequence
cuugaggucaagaguucgag

SEQ ID NO: 53672 - RNA, 20 nt, Artificial Sequence
  CIITA targeting sequence
acccaccucagccucccaaa

SEQ ID NO: 53673 - RNA, 20 nt, Artificial Sequence
  CIITA targeting sequence
gccucccaaagugcuggggu

SEQ ID NO: 53674 - RNA, 20 nt, Artificial Sequence
  CIITA targeting sequence
caaagugcugggguuacagg

SEQ ID NO: 53675 - RNA, 20 nt, Artificial Sequence
  CIITA targeting sequence
caccuguaaccccagcacuu

SEQ ID NO: 53676 - RNA, 20 nt, Artificial Sequence
  CIITA targeting sequence
cuaaauuuugacacagcuga

SEQ ID NO: 53677 - RNA, 20 nt, Artificial Sequence
  CIITA targeting sequence
aaauuuugacacagcugaga

SEQ ID NO: 53678 - RNA, 20 nt, Artificial Sequence
  CIITA targeting sequence
aaauuuagagaauggggggc

SEQ ID NO: 53679 - RNA, 20 nt, Artificial Sequence
  CIITA targeting sequence
gcugugucaaaauuuagaga

SEQ ID NO: 53680 - RNA, 20 nt, Artificial Sequence
  CIITA targeting sequence
cagcugugucaaaauuuaga

SEQ ID NO: 53681 - RNA, 20 nt, Artificial Sequence
  CIITA targeting sequence
ucuaaccaccaccacaacca

SEQ ID NO: 53682 - RNA, 20 nt, Artificial Sequence
  CIITA targeting sequence
aaccaccaccacaaccagua

SEQ ID NO: 53683 - RNA, 20 nt, Artificial Sequence
  CIITA targeting sequence
ucccuccaaaaaauucccac

SEQ ID NO: 53684 - RNA, 20 nt, Artificial Sequence
  CIITA targeting sequence
cuccaaaaaauucccacuug

SEQ ID NO: 53685 - RNA, 20 nt, Artificial Sequence
  CIITA targeting sequence
aaaaaauucccacuugcuac

SEQ ID NO: 53686 - RNA, 20 nt, Artificial Sequence
  CIITA targeting sequence
cacuugcuacccuuuuguca

SEQ ID NO: 53687 - RNA, 20 nt, Artificial Sequence
  CIITA targeting sequence
ucauccccuccccugcuccc

SEQ ID NO: 53688 - RNA, 20 nt, Artificial Sequence
  CIITA targeting sequence
uccccuccccugcucccagc

SEQ ID NO: 53689 - RNA, 20 nt, Artificial Sequence
  CIITA targeting sequence
ccuccccugcucccagcccc

SEQ ID NO: 53690 - RNA, 20 nt, Artificial Sequence
  CIITA targeting sequence
ccugcucccagccccugaca

SEQ ID NO: 53691 - RNA, 20 nt, Artificial Sequence
  CIITA targeting sequence
cagccccugacaaucacugg

SEQ ID NO: 53692 - RNA, 20 nt, Artificial Sequence
  CIITA targeting sequence
ggggcugggagcaggggagg

SEQ ID NO: 53693 - RNA, 20 nt, Artificial Sequence
  CIITA targeting sequence
cuggucuguuuucugucccu

SEQ ID NO: 53694 - RNA, 20 nt, Artificial Sequence
  CIITA targeting sequence
guuuucugucccuagaguug

SEQ ID NO: 53695 - RNA, 20 nt, Artificial Sequence
  CIITA targeting sequence
gucccuagaguuguagcuau

SEQ ID NO: 53696 - RNA, 20 nt, Artificial Sequence
  CIITA targeting sequence
cuagaguuguagcuaugccc

SEQ ID NO: 53697 - RNA, 20 nt, Artificial Sequence
  CIITA targeting sequence
agggacagaaaacagaccag

SEQ ID NO: 53698 - RNA, 20 nt, Artificial Sequence
  CIITA targeting sequence
gaugaauggaauccuguaga

SEQ ID NO: 53699 - RNA, 20 nt, Artificial Sequence
  CIITA targeting sequence
gacauuugggcauagcuaca

SEQ ID NO: 53700 - RNA, 20 nt, Artificial Sequence
  CIITA targeting sequence
ucugacauuugggcauagcu

SEQ ID NO: 53701 - RNA, 20 nt, Artificial Sequence
  CIITA targeting sequence
auucaucugacauuugggca

SEQ ID NO: 53702 - RNA, 20 nt, Artificial Sequence
  CIITA targeting sequence
uguagauguguacuuuuggg

SEQ ID NO: 53703 - RNA, 20 nt, Artificial Sequence
  CIITA targeting sequence
acaggauuccauucaucuga

SEQ ID NO: 53704 - RNA, 20 nt, Artificial Sequence
  CIITA targeting sequence
ggcuucuuuugcccaacacc

SEQ ID NO: 53705 - RNA, 20 nt, Artificial Sequence
  CIITA targeting sequence
uuugcccaacaccaaguauu

SEQ ID NO: 53706 - RNA, 20 nt, Artificial Sequence
  CIITA targeting sequence
aauacuugguguugggcaaa

SEQ ID NO: 53707 - RNA, 20 nt, Artificial Sequence
  CIITA targeting sequence
caaauacuugguguugggca

SEQ ID NO: 53708 - RNA, 20 nt, Artificial Sequence
  CIITA targeting sequence
uccaaguugcugguuguauc

SEQ ID NO: 53709 - RNA, 20 nt, Artificial Sequence
  CIITA targeting sequence
aaguugcugguuguaucggu

SEQ ID NO: 53710 - RNA, 20 nt, Artificial Sequence
  CIITA targeting sequence
guaguccacaccuuuucacu

SEQ ID NO: 53711 - RNA, 20 nt, Artificial Sequence
  CIITA targeting sequence
acaccuuuucacugcugagu

SEQ ID NO: 53712 - RNA, 20 nt, Artificial Sequence
  CIITA targeting sequence
cugcugaguaguaguuuaug

SEQ ID NO: 53713 - RNA, 20 nt, Artificial Sequence
  CIITA targeting sequence
gcagugaaaagguguggacu

SEQ ID NO: 53714 - RNA, 20 nt, Artificial Sequence
  CIITA targeting sequence
acaccauaaacuacuacuca

SEQ ID NO: 53715 - RNA, 20 nt, Artificial Sequence
  CIITA targeting sequence
ucuguuaaauuggguugucu

SEQ ID NO: 53716 - RNA, 20 nt, Artificial Sequence
  CIITA targeting sequence
guuaaauuggguugucucca

SEQ ID NO: 53717 - RNA, 20 nt, Artificial Sequence
  CIITA targeting sequence
ccaguuuggggugaugauga

SEQ ID NO: 53718 - RNA, 20 nt, Artificial Sequence
  CIITA targeting sequence
aguuuggggugaugaugaau

SEQ ID NO: 53719 - RNA, 20 nt, Artificial Sequence
  CIITA targeting sequence
ccccaaacuggagacaaccc

SEQ ID NO: 53720 - RNA, 20 nt, Artificial Sequence
  CIITA targeting sequence
ucaccccaaacuggagacaa

SEQ ID NO: 53721 - RNA, 20 nt, Artificial Sequence
  CIITA targeting sequence
ucaucaccccaaacuggaga

SEQ ID NO: 53722 - RNA, 20 nt, Artificial Sequence
  CIITA targeting sequence
auucaucaucaccccaaacu

SEQ ID NO: 53723 - RNA, 20 nt, Artificial Sequence
  CIITA targeting sequence
acaucuauguauagguuuuu

SEQ ID NO: 53724 - RNA, 20 nt, Artificial Sequence
  CIITA targeting sequence
guacuucauucagauuucuc

SEQ ID NO: 53725 - RNA, 20 nt, Artificial Sequence
  CIITA targeting sequence
uucagauuucucuggguuuu

SEQ ID NO: 53726 - RNA, 20 nt, Artificial Sequence
  CIITA targeting sequence
gauuucucuggguuuuuccu

SEQ ID NO: 53727 - RNA, 20 nt, Artificial Sequence
  CIITA targeting sequence
gaaugaaguacagacuuggg

SEQ ID NO: 53728 - RNA, 20 nt, Artificial Sequence
  CIITA targeting sequence
cuggguuuuuccuaauguuc

SEQ ID NO: 53729 - RNA, 20 nt, Artificial Sequence
  CIITA targeting sequence
ggguuuuuccuaauguucuu

SEQ ID NO: 53730 - RNA, 20 nt, Artificial Sequence
  CIITA targeting sequence
uaauguucuuuccuguucca

SEQ ID NO: 53731 - RNA, 20 nt, Artificial Sequence
  CIITA targeting sequence
uuccuguuccagggucccau

SEQ ID NO: 53732 - RNA, 20 nt, Artificial Sequence
  CIITA targeting sequence
uguuccagggucccauccgg

SEQ ID NO: 53733 - RNA, 20 nt, Artificial Sequence
  CIITA targeting sequence
agggucccauccgggacacc

SEQ ID NO: 53734 - RNA, 20 nt, Artificial Sequence
  CIITA targeting sequence
cauccgggacaccacauucc

SEQ ID NO: 53735 - RNA, 20 nt, Artificial Sequence
  CIITA targeting sequence
gggacaccacauuccauuuc

SEQ ID NO: 53736 - RNA, 20 nt, Artificial Sequence
  CIITA targeting sequence
cggaugggacccuggaacag

SEQ ID NO: 53737 - RNA, 20 nt, Artificial Sequence
  CIITA targeting sequence
auuucgucaucaugucuccc

SEQ ID NO: 53738 - RNA, 20 nt, Artificial Sequence
  CIITA targeting sequence
ucaucaugucucccuaggug

SEQ ID NO: 53739 - RNA, 20 nt, Artificial Sequence
  CIITA targeting sequence
ucaugucucccuaggugcuc

SEQ ID NO: 53740 - RNA, 20 nt, Artificial Sequence
  CIITA targeting sequence
ugucucccuaggugcucucc

SEQ ID NO: 53741 - RNA, 20 nt, Artificial Sequence
  CIITA targeting sequence
cccuaggugcucucccuggc

SEQ ID NO: 53742 - RNA, 20 nt, Artificial Sequence
  CIITA targeting sequence
cuaggugcucucccuggcug

SEQ ID NO: 53743 - RNA, 20 nt, Artificial Sequence
  CIITA targeting sequence
cccuggcugggucguucaau

SEQ ID NO: 53744 - RNA, 20 nt, Artificial Sequence
  CIITA targeting sequence
cuggcugggucguucaauca

SEQ ID NO: 53745 - RNA, 20 nt, Artificial Sequence
  CIITA targeting sequence
uucaaucaguugcuuuuaau

SEQ ID NO: 53746 - RNA, 20 nt, Artificial Sequence
  CIITA targeting sequence
aucaguugcuuuuaauugca

SEQ ID NO: 53747 - RNA, 20 nt, Artificial Sequence
  CIITA targeting sequence
guugcuuuuaauugcauuua

SEQ ID NO: 53748 - RNA, 20 nt, Artificial Sequence
  CIITA targeting sequence
gcaccaaaauuaaauuuaaa

SEQ ID NO: 53749 - RNA, 20 nt, Artificial Sequence
  CIITA targeting sequence
cugucugcaccaaaauuaaa

SEQ ID NO: 53750 - RNA, 20 nt, Artificial Sequence
  CIITA targeting sequence
cacugucugcaccaaaauua

SEQ ID NO: 53751 - RNA, 20 nt, Artificial Sequence
  CIITA targeting sequence
guuacagaauucuuagguua

SEQ ID NO: 53752 - RNA, 20 nt, Artificial Sequence
  CIITA targeting sequence
guaacagaucucacugucug

SEQ ID NO: 53753 - RNA, 20 nt, Artificial Sequence
  CIITA targeting sequence
uagguuaaaacuuagucaca

SEQ ID NO: 53754 - RNA, 20 nt, Artificial Sequence
  CIITA targeting sequence
caauggcugggugcaguggc

SEQ ID NO: 53755 - RNA, 20 nt, Artificial Sequence
  CIITA targeting sequence
cgccuguaauugaaacacuu

SEQ ID NO: 53756 - RNA, 20 nt, Artificial Sequence
  CIITA targeting sequence
auuacaggcgugagccacug

SEQ ID NO: 53757 - RNA, 20 nt, Artificial Sequence
  CIITA targeting sequence
aaguguuucaauuacaggcg

SEQ ID NO: 53758 - RNA, 20 nt, Artificial Sequence
  CIITA targeting sequence
caaaguguuucaauuacagg

SEQ ID NO: 53759 - RNA, 20 nt, Artificial Sequence
  CIITA targeting sequence
aggcaggcugaucacuggag

SEQ ID NO: 53760 - RNA, 20 nt, Artificial Sequence
  CIITA targeting sequence
accucucaaaguguuucaau

SEQ ID NO: 53761 - RNA, 20 nt, Artificial Sequence
  CIITA targeting sequence
gccugccucgaccucucaaa

SEQ ID NO: 53762 - RNA, 20 nt, Artificial Sequence
  CIITA targeting sequence
cuggaggccagguguucaag

SEQ ID NO: 53763 - RNA, 20 nt, Artificial Sequence
  CIITA targeting sequence
agugaucagccugccucgac

SEQ ID NO: 53764 - RNA, 20 nt, Artificial Sequence
  CIITA targeting sequence
agaccagcuugggcaacaua

SEQ ID NO: 53765 - RNA, 20 nt, Artificial Sequence
  CIITA targeting sequence
ugaacaccuggccuccagug

SEQ ID NO: 53766 - RNA, 20 nt, Artificial Sequence
  CIITA targeting sequence
cccgucucuacuaaaaacac

SEQ ID NO: 53767 - RNA, 20 nt, Artificial Sequence
  CIITA targeting sequence
cuacuaaaaacacaaaaaaa

SEQ ID NO: 53768 - RNA, 20 nt, Artificial Sequence
  CIITA targeting sequence
acuaaaaacacaaaaaaauu

SEQ ID NO: 53769 - RNA, 20 nt, Artificial Sequence
  CIITA targeting sequence
cagcuacucuggaggccgaa

SEQ ID NO: 53770 - RNA, 20 nt, Artificial Sequence
  CIITA targeting sequence
ggaggccgaagcaugagaau

SEQ ID NO: 53771 - RNA, 20 nt, Artificial Sequence
  CIITA targeting sequence
agaguagcugggauuacagg

SEQ ID NO: 53772 - RNA, 20 nt, Artificial Sequence
  CIITA targeting sequence
gccuccagaguagcugggau

SEQ ID NO: 53773 - RNA, 20 nt, Artificial Sequence
  CIITA targeting sequence
ugcuucggccuccagaguag

SEQ ID NO: 53774 - RNA, 20 nt, Artificial Sequence
  CIITA targeting sequence
caugcuucggccuccagagu

SEQ ID NO: 53775 - RNA, 20 nt, Artificial Sequence
  CIITA targeting sequence
cuggaaccugggaggcggag

SEQ ID NO: 53776 - RNA, 20 nt, Artificial Sequence
  CIITA targeting sequence
ggaaccugggaggcggaggu

SEQ ID NO: 53777 - RNA, 20 nt, Artificial Sequence
  CIITA targeting sequence
agagauucucaugcuucggc

SEQ ID NO: 53778 - RNA, 20 nt, Artificial Sequence
  CIITA targeting sequence
cagguuccagagauucucau

SEQ ID NO: 53779 - RNA, 20 nt, Artificial Sequence
  CIITA targeting sequence
gccucccagguuccagagau

SEQ ID NO: 53780 - RNA, 20 nt, Artificial Sequence
  CIITA targeting sequence
gugagccaagaucaugccac

SEQ ID NO: 53781 - RNA, 20 nt, Artificial Sequence
  CIITA targeting sequence
cugaaaccuccgccucccag

SEQ ID NO: 53782 - RNA, 20 nt, Artificial Sequence
  CIITA targeting sequence
uggcucacugaaaccuccgc

SEQ ID NO: 53783 - RNA, 20 nt, Artificial Sequence
  CIITA targeting sequence
ugccacugcacuccauucug

SEQ ID NO: 53784 - RNA, 20 nt, Artificial Sequence
  CIITA targeting sequence
auucuggacgacagagccag

SEQ ID NO: 53785 - RNA, 20 nt, Artificial Sequence
  CIITA targeting sequence
ggacgacagagccagacucu

SEQ ID NO: 53786 - RNA, 20 nt, Artificial Sequence
  CIITA targeting sequence
agaauggagugcaguggcau

SEQ ID NO: 53787 - RNA, 20 nt, Artificial Sequence
  CIITA targeting sequence
uccagaauggagugcagugg

SEQ ID NO: 53788 - RNA, 20 nt, Artificial Sequence
  CIITA targeting sequence
gucguccagaauggagugca

SEQ ID NO: 53789 - RNA, 20 nt, Artificial Sequence
  CIITA targeting sequence
ggcucugucguccagaaugg

SEQ ID NO: 53790 - RNA, 20 nt, Artificial Sequence
  CIITA targeting sequence
gucucaaaaacaaaaaacaa

SEQ ID NO: 53791 - RNA, 20 nt, Artificial Sequence
  CIITA targeting sequence
caaaaacaaaaaacaaaaaa

SEQ ID NO: 53792 - RNA, 20 nt, Artificial Sequence
  CIITA targeting sequence
aaaacaaaaaacaaaaaaag

SEQ ID NO: 53793 - RNA, 20 nt, Artificial Sequence
  CIITA targeting sequence
caaaauuauuauggggcacc

SEQ ID NO: 53794 - RNA, 20 nt, Artificial Sequence
  CIITA targeting sequence
ggggcuacuacugggugccc

SEQ ID NO: 53795 - RNA, 20 nt, Artificial Sequence
  CIITA targeting sequence
agcucaggggcuacuacugg

SEQ ID NO: 53796 - RNA, 20 nt, Artificial Sequence
  CIITA targeting sequence
accacacauccagcucaggg

SEQ ID NO: 53797 - RNA, 20 nt, Artificial Sequence
  CIITA targeting sequence
ccagauguuaaccugaaguc

SEQ ID NO: 53798 - RNA, 20 nt, Artificial Sequence
  CIITA targeting sequence
ggggagucuaccacacaucc

SEQ ID NO: 53799 - RNA, 20 nt, Artificial Sequence
  CIITA targeting sequence
gguuaacaucuggggagucu

SEQ ID NO: 53800 - RNA, 20 nt, Artificial Sequence
  CIITA targeting sequence
gcccuacuguggcgaaaccu

SEQ ID NO: 53801 - RNA, 20 nt, Artificial Sequence
  CIITA targeting sequence
ccacaguagggcagacuuca

SEQ ID NO: 53802 - RNA, 20 nt, Artificial Sequence
  CIITA targeting sequence
agcacacaagcagguuucgc

SEQ ID NO: 53803 - RNA, 20 nt, Artificial Sequence
  CIITA targeting sequence
uuuuucuagcacacaagcag

SEQ ID NO: 53804 - RNA, 20 nt, Artificial Sequence
  CIITA targeting sequence
gcagcuugggucuuuuuucu

SEQ ID NO: 53805 - RNA, 20 nt, Artificial Sequence
  CIITA targeting sequence
ugccccauuuguccucaccc

SEQ ID NO: 53806 - RNA, 20 nt, Artificial Sequence
  CIITA targeting sequence
ucacccaacuucugguaagu

SEQ ID NO: 53807 - RNA, 20 nt, Artificial Sequence
  CIITA targeting sequence
cccaacuucugguaaguagu

SEQ ID NO: 53808 - RNA, 20 nt, Artificial Sequence
  CIITA targeting sequence
gguaaguaguguccauugaa

SEQ ID NO: 53809 - RNA, 20 nt, Artificial Sequence
  CIITA targeting sequence
auugaaaaaugcuaguuggg

SEQ ID NO: 53810 - RNA, 20 nt, Artificial Sequence
  CIITA targeting sequence
auggacacuacuuaccagaa

SEQ ID NO: 53811 - RNA, 20 nt, Artificial Sequence
  CIITA targeting sequence
gcccaacuagcauuuuucaa

SEQ ID NO: 53812 - RNA, 20 nt, Artificial Sequence
  CIITA targeting sequence
ggccaccaugucagcccaac

SEQ ID NO: 53813 - RNA, 20 nt, Artificial Sequence
  CIITA targeting sequence
caggagucuguuggcggggu

SEQ ID NO: 53814 - RNA, 20 nt, Artificial Sequence
  CIITA targeting sequence
ggagucuguuggcggggugg

SEQ ID NO: 53815 - RNA, 20 nt, Artificial Sequence
  CIITA targeting sequence
ugagaugcauuauugcucag

SEQ ID NO: 53816 - RNA, 20 nt, Artificial Sequence
  CIITA targeting sequence
guuggcgggguggagguagg

SEQ ID NO: 53817 - RNA, 20 nt, Artificial Sequence
  CIITA targeting sequence
accccgccaacagacuccug

SEQ ID NO: 53818 - RNA, 20 nt, Artificial Sequence
  CIITA targeting sequence
uaccuccaccccgccaacag

SEQ ID NO: 53819 - RNA, 20 nt, Artificial Sequence
  CIITA targeting sequence
uuuuccuaccuccaccccgc

SEQ ID NO: 53820 - RNA, 20 nt, Artificial Sequence
  CIITA targeting sequence
ugacaguccccucagaaaug

SEQ ID NO: 53821 - RNA, 20 nt, Artificial Sequence
  CIITA targeting sequence
ggaaaaacacacagugcccu

SEQ ID NO: 53822 - RNA, 20 nt, Artificial Sequence
  CIITA targeting sequence
ccucagaaaugcugguggcu

SEQ ID NO: 53823 - RNA, 20 nt, Artificial Sequence
  CIITA targeting sequence
gaaaugcugguggcuuggug

SEQ ID NO: 53824 - RNA, 20 nt, Artificial Sequence
  CIITA targeting sequence
gaggggacugucaggaaaaa

SEQ ID NO: 53825 - RNA, 20 nt, Artificial Sequence
  CIITA targeting sequence
agcaccaagccaccagcauu

SEQ ID NO: 53826 - RNA, 20 nt, Artificial Sequence
  CIITA targeting sequence
ccauguuagcugagcugugu

SEQ ID NO: 53827 - RNA, 20 nt, Artificial Sequence
  CIITA targeting sequence
gcuaacauggugaggcaaca

SEQ ID NO: 53828 - RNA, 20 nt, Artificial Sequence
  CIITA targeting sequence
uugaauguuaacaacuuuca

SEQ ID NO: 53829 - RNA, 20 nt, Artificial Sequence
  CIITA targeting sequence
aagaaaccacacagcucagc

SEQ ID NO: 53830 - RNA, 20 nt, Artificial Sequence
  CIITA targeting sequence
cuguuucggcuugaguuucc

SEQ ID NO: 53831 - RNA, 20 nt, Artificial Sequence
  CIITA targeting sequence
gcuugaguuuccucccugac

SEQ ID NO: 53832 - RNA, 20 nt, Artificial Sequence
  CIITA targeting sequence
agccgaaacagugaaaguug

SEQ ID NO: 53833 - RNA, 20 nt, Artificial Sequence
  CIITA targeting sequence
ucccugacaucaccagauga

SEQ ID NO: 53834 - RNA, 20 nt, Artificial Sequence
  CIITA targeting sequence
cugacaucaccagaugaaaa

SEQ ID NO: 53835 - RNA, 20 nt, Artificial Sequence
  CIITA targeting sequence
gggaggaaacucaagccgaa

SEQ ID NO: 53836 - RNA, 20 nt, Artificial Sequence
  CIITA targeting sequence
ccagaugaaaacauauguca

SEQ ID NO: 53837 - RNA, 20 nt, Artificial Sequence
  CIITA targeting sequence
ggugaugucagggaggaaac

SEQ ID NO: 53838 - RNA, 20 nt, Artificial Sequence
  CIITA targeting sequence
ucuggugaugucagggagga

SEQ ID NO: 53839 - RNA, 20 nt, Artificial Sequence
  CIITA targeting sequence
gagguuuuggguuucuggug

SEQ ID NO: 53840 - RNA, 20 nt, Artificial Sequence
  CIITA targeting sequence
gacauauguuuucaucuggu

SEQ ID NO: 53841 - RNA, 20 nt, Artificial Sequence
  CIITA targeting sequence
ggugccaaauccaagauggc

SEQ ID NO: 53842 - RNA, 20 nt, Artificial Sequence
  CIITA targeting sequence
aagauggcuuaucagcaagc

SEQ ID NO: 53843 - RNA, 20 nt, Artificial Sequence
  CIITA targeting sequence
uggauuuggcaccagaaacc

SEQ ID NO: 53844 - RNA, 20 nt, Artificial Sequence
  CIITA targeting sequence
gcaagcgccccccgccagac

SEQ ID NO: 53845 - RNA, 20 nt, Artificial Sequence
  CIITA targeting sequence
ggcggggggcgcuugcugau

SEQ ID NO: 53846 - RNA, 20 nt, Artificial Sequence
  CIITA targeting sequence
acugucuggcggggggcgcu

SEQ ID NO: 53847 - RNA, 20 nt, Artificial Sequence
  CIITA targeting sequence
gccccagcacagccuccacu

SEQ ID NO: 53848 - RNA, 20 nt, Artificial Sequence
  CIITA targeting sequence
ccuuugacauuggcuuuuuu

SEQ ID NO: 53849 - RNA, 20 nt, Artificial Sequence
  CIITA targeting sequence
aaggggaagcagcucugccc

SEQ ID NO: 53850 - RNA, 20 nt, Artificial Sequence
  CIITA targeting sequence
aaaaccgaaaauaagcaacc

SEQ ID NO: 53851 - RNA, 20 nt, Artificial Sequence
  CIITA targeting sequence
guuuuagaaaaaagccaaug

SEQ ID NO: 53852 - RNA, 20 nt, Artificial Sequence
  CIITA targeting sequence
cagccacgguugcuuauuuu

SEQ ID NO: 53853 - RNA, 20 nt, Artificial Sequence
  CIITA targeting sequence
cuuuucuuggaacugcuuua

SEQ ID NO: 53854 - RNA, 20 nt, Artificial Sequence
  CIITA targeting sequence
uggaacugcuuuacauuacc

SEQ ID NO: 53855 - RNA, 20 nt, Artificial Sequence
  CIITA targeting sequence
aagaaaagugaagucacagc

SEQ ID NO: 53856 - RNA, 20 nt, Artificial Sequence
  CIITA targeting sequence
auuugggggguaauguaaag

SEQ ID NO: 53857 - RNA, 20 nt, Artificial Sequence
  CIITA targeting sequence
ccauuugggggguaauguaa

SEQ ID NO: 53858 - RNA, 20 nt, Artificial Sequence
  CIITA targeting sequence
uuuagcagcuuuuggauugc

SEQ ID NO: 53859 - RNA, 20 nt, Artificial Sequence
  CIITA targeting sequence
aaaagcugcuaaaugagggu

SEQ ID NO: 53860 - RNA, 20 nt, Artificial Sequence
  CIITA targeting sequence
cuaauucuuucuguugcaua

SEQ ID NO: 53861 - RNA, 20 nt, Artificial Sequence
  CIITA targeting sequence
aauucuuucuguugcauauu

SEQ ID NO: 53862 - RNA, 20 nt, Artificial Sequence
  CIITA targeting sequence
uucuguugcauauucuugua

SEQ ID NO: 53863 - RNA, 20 nt, Artificial Sequence
  CIITA targeting sequence
guugcauauucuuguaaugc

SEQ ID NO: 53864 - RNA, 20 nt, Artificial Sequence
  CIITA targeting sequence
uguaaugcucaaguuuuacu

SEQ ID NO: 53865 - RNA, 20 nt, Artificial Sequence
  CIITA targeting sequence
aguuuuacugacaaagucuu

SEQ ID NO: 53866 - RNA, 20 nt, Artificial Sequence
  CIITA targeting sequence
guaaaacuugagcauuacaa

SEQ ID NO: 53867 - RNA, 20 nt, Artificial Sequence
  CIITA targeting sequence
ucugcaucaggugaagcagg

SEQ ID NO: 53868 - RNA, 20 nt, Artificial Sequence
  CIITA targeting sequence
gcaucaggugaagcaggagg

SEQ ID NO: 53869 - RNA, 20 nt, Artificial Sequence
  CIITA targeting sequence
ggugaagcaggaggaggaag

SEQ ID NO: 53870 - RNA, 20 nt, Artificial Sequence
  CIITA targeting sequence
ccugaugcagaagacuuugu

SEQ ID NO: 53871 - RNA, 20 nt, Artificial Sequence
  CIITA targeting sequence
ugcuucaccugaugcagaag

SEQ ID NO: 53872 - RNA, 20 nt, Artificial Sequence
  CIITA targeting sequence
uccugcuucaccugaugcag

SEQ ID NO: 53873 - RNA, 20 nt, Artificial Sequence
  CIITA targeting sequence
uccuccugcuucaccugaug

SEQ ID NO: 53874 - RNA, 20 nt, Artificial Sequence
  CIITA targeting sequence
uuccuccuccugcuucaccu

SEQ ID NO: 53875 - RNA, 20 nt, Artificial Sequence
  CIITA targeting sequence
uuccuuccuccuccugcuuc

SEQ ID NO: 53876 - RNA, 20 nt, Artificial Sequence
  CIITA targeting sequence
cauggucauuccuuccuccu

SEQ ID NO: 53877 - RNA, 20 nt, Artificial Sequence
  CIITA targeting sequence
guuacuucacauggucauuc

SEQ ID NO: 53878 - RNA, 20 nt, Artificial Sequence
  CIITA targeting sequence
ugguugaggagaaaaagcac

SEQ ID NO: 53879 - RNA, 20 nt, Artificial Sequence
  CIITA targeting sequence
accaugaaaccacacaccca

SEQ ID NO: 53880 - RNA, 20 nt, Artificial Sequence
  CIITA targeting sequence
ucaaccaugaaaccacacac

SEQ ID NO: 53881 - RNA, 20 nt, Artificial Sequence
  CIITA targeting sequence
ccucaaccaugaaaccacac

SEQ ID NO: 53882 - RNA, 20 nt, Artificial Sequence
  CIITA targeting sequence
aggugcuuuuucuccucaac

SEQ ID NO: 53883 - RNA, 20 nt, Artificial Sequence
  CIITA targeting sequence
uccaggugcuuuuucuccuc

SEQ ID NO: 53884 - RNA, 20 nt, Artificial Sequence
  CIITA targeting sequence
acacacacugugucuuccag

SEQ ID NO: 53885 - RNA, 20 nt, Artificial Sequence
  CIITA targeting sequence
aguuccaagggugacaaccc

SEQ ID NO: 53886 - RNA, 20 nt, Artificial Sequence
  CIITA targeting sequence
aagggugacaacccugcgau

SEQ ID NO: 53887 - RNA, 20 nt, Artificial Sequence
  CIITA targeting sequence
cccuuggaacuggaaggcau

SEQ ID NO: 53888 - RNA, 20 nt, Artificial Sequence
  CIITA targeting sequence
caggguugucacccuuggaa

SEQ ID NO: 53889 - RNA, 20 nt, Artificial Sequence
  CIITA targeting sequence
gcuggccagcagaugggcua

SEQ ID NO: 53890 - RNA, 20 nt, Artificial Sequence
  CIITA targeting sequence
gcuggccagcagaucgcagg

SEQ ID NO: 53891 - RNA, 20 nt, Artificial Sequence
  CIITA targeting sequence
ggcuacagccgaaacuuaca

SEQ ID NO: 53892 - RNA, 20 nt, Artificial Sequence
  CIITA targeting sequence
gcuguagccugauguuuagc

SEQ ID NO: 53893 - RNA, 20 nt, Artificial Sequence
  CIITA targeting sequence
guaaguuucggcuguagccu

SEQ ID NO: 53894 - RNA, 20 nt, Artificial Sequence
  CIITA targeting sequence
aggacaaggggaaaaaugca

SEQ ID NO: 53895 - RNA, 20 nt, Artificial Sequence
  CIITA targeting sequence
uugaagcaggcagcugcucu

SEQ ID NO: 53896 - RNA, 20 nt, Artificial Sequence
  CIITA targeting sequence
ccuuguccuugaagcaggca

SEQ ID NO: 53897 - RNA, 20 nt, Artificial Sequence
  CIITA targeting sequence
gucauaaugaccuacauuua

SEQ ID NO: 53898 - RNA, 20 nt, Artificial Sequence
  CIITA targeting sequence
uaaugaccuacauuuagcag

SEQ ID NO: 53899 - RNA, 20 nt, Artificial Sequence
  CIITA targeting sequence
uuaugacugaaaaugcauuu

SEQ ID NO: 53900 - RNA, 20 nt, Artificial Sequence
  CIITA targeting sequence
gcuaaauguaggucauuaug

SEQ ID NO: 53901 - RNA, 20 nt, Artificial Sequence
  CIITA targeting sequence
gagcccgugcgaaaggacau

SEQ ID NO: 53902 - RNA, 20 nt, Artificial Sequence
  CIITA targeting sequence
gaaauaucugcuaaauguag

SEQ ID NO: 53903 - RNA, 20 nt, Artificial Sequence
  CIITA targeting sequence
cacgggcuccgaaauaucug

SEQ ID NO: 53904 - RNA, 20 nt, Artificial Sequence
  CIITA targeting sequence
uuucgcacgggcuccgaaau

SEQ ID NO: 53905 - RNA, 20 nt, Artificial Sequence
  CIITA targeting sequence
ucaaagggccucuuccuccu

SEQ ID NO: 53906 - RNA, 20 nt, Artificial Sequence
  CIITA targeting sequence
aagggccucuuccuccuugu

SEQ ID NO: 53907 - RNA, 20 nt, Artificial Sequence
  CIITA targeting sequence
uccuccuugugauaagggag

SEQ ID NO: 53908 - RNA, 20 nt, Artificial Sequence
  CIITA targeting sequence
uccuugugauaagggagaca

SEQ ID NO: 53909 - RNA, 20 nt, Artificial Sequence
  CIITA targeting sequence
uugugauaagggagacagug

SEQ ID NO: 53910 - RNA, 20 nt, Artificial Sequence
  CIITA targeting sequence
caaggaggaagaggcccuuu

SEQ ID NO: 53911 - RNA, 20 nt, Artificial Sequence
  CIITA targeting sequence
cuuaucacaaggaggaagag

SEQ ID NO: 53912 - RNA, 20 nt, Artificial Sequence
  CIITA targeting sequence
cccuuaucacaaggaggaag

SEQ ID NO: 53913 - RNA, 20 nt, Artificial Sequence
  CIITA targeting sequence
cugucucccuuaucacaagg

SEQ ID NO: 53914 - RNA, 20 nt, Artificial Sequence
  CIITA targeting sequence
aacguggggcccaguccugg

SEQ ID NO: 53915 - RNA, 20 nt, Artificial Sequence
  CIITA targeting sequence
ugguccugcccguuccuguc

SEQ ID NO: 53916 - RNA, 20 nt, Artificial Sequence
  CIITA targeting sequence
ugcccguuccugucugacuu

SEQ ID NO: 53917 - RNA, 20 nt, Artificial Sequence
  CIITA targeting sequence
ugucugacuuuggccuugga

SEQ ID NO: 53918 - RNA, 20 nt, Artificial Sequence
  CIITA targeting sequence
gacuuuggccuuggaagucu

SEQ ID NO: 53919 - RNA, 20 nt, Artificial Sequence
  CIITA targeting sequence
gacaggaacgggcaggacca

SEQ ID NO: 53920 - RNA, 20 nt, Artificial Sequence
  CIITA targeting sequence
aaggccaaagucagacagga

SEQ ID NO: 53921 - RNA, 20 nt, Artificial Sequence
  CIITA targeting sequence
gugaagccgagacaauucau

SEQ ID NO: 53922 - RNA, 20 nt, Artificial Sequence
  CIITA targeting sequence
cagacuuccaaggccaaagu

SEQ ID NO: 53923 - RNA, 20 nt, Artificial Sequence
  CIITA targeting sequence
gcuucacagacuuccaaggc

SEQ ID NO: 53924 - RNA, 20 nt, Artificial Sequence
  CIITA targeting sequence
cggcuucacagacuuccaag

SEQ ID NO: 53925 - RNA, 20 nt, Artificial Sequence
  CIITA targeting sequence
uccuucaaagggugguaccg

SEQ ID NO: 53926 - RNA, 20 nt, Artificial Sequence
  CIITA targeting sequence
uucaaagggugguaccgggu

SEQ ID NO: 53927 - RNA, 20 nt, Artificial Sequence
  CIITA targeting sequence
aagggugguaccggguaagu

SEQ ID NO: 53928 - RNA, 20 nt, Artificial Sequence
  CIITA targeting sequence
ugggaauggaaucccaagau

SEQ ID NO: 53929 - RNA, 20 nt, Artificial Sequence
  CIITA targeting sequence
caagaacuuacccgguacca

SEQ ID NO: 53930 - RNA, 20 nt, Artificial Sequence
  CIITA targeting sequence
auucccaagaacuuacccgg

SEQ ID NO: 53931 - RNA, 20 nt, Artificial Sequence
  CIITA targeting sequence
caagauccacuccugagagu

SEQ ID NO: 53932 - RNA, 20 nt, Artificial Sequence
  CIITA targeting sequence
ugggauuccauucccaagaa

SEQ ID NO: 53933 - RNA, 20 nt, Artificial Sequence
  CIITA targeting sequence
acuccugagaguggaucuuu

SEQ ID NO: 53934 - RNA, 20 nt, Artificial Sequence
  CIITA targeting sequence
ugagaguggaucuuuguaga

SEQ ID NO: 53935 - RNA, 20 nt, Artificial Sequence
  CIITA targeting sequence
ggaguggaucuugggauucc

SEQ ID NO: 53936 - RNA, 20 nt, Artificial Sequence
  CIITA targeting sequence
caggaguggaucuugggauu

SEQ ID NO: 53937 - RNA, 20 nt, Artificial Sequence
  CIITA targeting sequence
acucucaggaguggaucuug

SEQ ID NO: 53938 - RNA, 20 nt, Artificial Sequence
  CIITA targeting sequence
uuguagacaggcacauacgu

SEQ ID NO: 53939 - RNA, 20 nt, Artificial Sequence
  CIITA targeting sequence
acaaagauccacucucagga

SEQ ID NO: 53940 - RNA, 20 nt, Artificial Sequence
  CIITA targeting sequence
gaaaucaucuguugcuaucu

SEQ ID NO: 53941 - RNA, 20 nt, Artificial Sequence
  CIITA targeting sequence
gaacaacguaugugccuguc

SEQ ID NO: 53942 - RNA, 20 nt, Artificial Sequence
  CIITA targeting sequence
ucuguugcuaucucuguccc

SEQ ID NO: 53943 - RNA, 20 nt, Artificial Sequence
  CIITA targeting sequence
guugcuaucucugucccugu

SEQ ID NO: 53944 - RNA, 20 nt, Artificial Sequence
  CIITA targeting sequence
cugucccuguuggaggcgcu

SEQ ID NO: 53945 - RNA, 20 nt, Artificial Sequence
  CIITA targeting sequence
gucccuguuggaggcgcuuc

SEQ ID NO: 53946 - RNA, 20 nt, Artificial Sequence
  CIITA targeting sequence
cuguuggaggcgcuuccagu

SEQ ID NO: 53947 - RNA, 20 nt, Artificial Sequence
  CIITA targeting sequence
aacagggacagagauagcaa

SEQ ID NO: 53948 - RNA, 20 nt, Artificial Sequence
  CIITA targeting sequence
agugacgucgugauuguguc

SEQ ID NO: 53949 - RNA, 20 nt, Artificial Sequence
  CIITA targeting sequence
cuggaagcgccuccaacagg

SEQ ID NO: 53950 - RNA, 20 nt, Artificial Sequence
  CIITA targeting sequence
ugauuguguccuacuuaucu

SEQ ID NO: 53951 - RNA, 20 nt, Artificial Sequence
  CIITA targeting sequence
cgacgucacuggaagcgccu

SEQ ID NO: 53952 - RNA, 20 nt, Artificial Sequence
  CIITA targeting sequence
uacuuaucucaguaucccug

SEQ ID NO: 53953 - RNA, 20 nt, Artificial Sequence
  CIITA targeting sequence
caguaucccugcccagcaug

SEQ ID NO: 53954 - RNA, 20 nt, Artificial Sequence
  CIITA targeting sequence
guaucccugcccagcauggg

SEQ ID NO: 53955 - RNA, 20 nt, Artificial Sequence
  CIITA targeting sequence
cugcccagcauggggucuua

SEQ ID NO: 53956 - RNA, 20 nt, Artificial Sequence
  CIITA targeting sequence
uagguaacauacaugggcag

SEQ ID NO: 53957 - RNA, 20 nt, Artificial Sequence
  CIITA targeting sequence
gucaauguuaggacuggcug

SEQ ID NO: 53958 - RNA, 20 nt, Artificial Sequence
  CIITA targeting sequence
auguuaggacuggcuggguu

SEQ ID NO: 53959 - RNA, 20 nt, Artificial Sequence
  CIITA targeting sequence
uaacauugaccgacugccca

SEQ ID NO: 53960 - RNA, 20 nt, Artificial Sequence
  CIITA targeting sequence
agccuaaaacccagccaguc

SEQ ID NO: 53961 - RNA, 20 nt, Artificial Sequence
  CIITA targeting sequence
ucuagccuaaaacccagcca

SEQ ID NO: 53962 - RNA, 20 nt, Artificial Sequence
  CIITA targeting sequence
gucuucuagccuaaaaccca

SEQ ID NO: 53963 - RNA, 20 nt, Artificial Sequence
  CIITA targeting sequence
ucugucuucuagccuaaaac

SEQ ID NO: 53964 - RNA, 20 nt, Artificial Sequence
  CIITA targeting sequence
uaaauuuacacuuggcccgc

SEQ ID NO: 53965 - RNA, 20 nt, Artificial Sequence
  CIITA targeting sequence
gaagaaaggagcccccugcu

SEQ ID NO: 53966 - RNA, 20 nt, Artificial Sequence
  CIITA targeting sequence
gaaaacugcugcgggccaag

SEQ ID NO: 53967 - RNA, 20 nt, Artificial Sequence
  CIITA targeting sequence
ucugaaaacugcugcgggcc

SEQ ID NO: 53968 - RNA, 20 nt, Artificial Sequence
  CIITA targeting sequence
uuucuucugaaaacugcugc

SEQ ID NO: 53969 - RNA, 20 nt, Artificial Sequence
  CIITA targeting sequence
aaaggcgcuacuaagcaggg

SEQ ID NO: 53970 - RNA, 20 nt, Artificial Sequence
  CIITA targeting sequence
ggccugcuauaaacuacaca

SEQ ID NO: 53971 - RNA, 20 nt, Artificial Sequence
  CIITA targeting sequence
agccagcacccucaggccug

SEQ ID NO: 53972 - RNA, 20 nt, Artificial Sequence
  CIITA targeting sequence
ccaacagucuagccagcacc

SEQ ID NO: 53973 - RNA, 20 nt, Artificial Sequence
  CIITA targeting sequence
uuaagcacagaggaaagauu

SEQ ID NO: 53974 - RNA, 20 nt, Artificial Sequence
  CIITA targeting sequence
gugcuuaaagagcacucccc

SEQ ID NO: 53975 - RNA, 20 nt, Artificial Sequence
  CIITA targeting sequence
ucugugcuuaaagagcacuc

SEQ ID NO: 53976 - RNA, 20 nt, Artificial Sequence
  CIITA targeting sequence
uuccucugugcuuaaagagc

SEQ ID NO: 53977 - RNA, 20 nt, Artificial Sequence
  CIITA targeting sequence
uuaccaaaucuuuccucugu

SEQ ID NO: 53978 - RNA, 20 nt, Artificial Sequence
  CIITA targeting sequence
acccuuuuaugucuuuacca

SEQ ID NO: 53979 - RNA, 20 nt, Artificial Sequence
  CIITA targeting sequence
uccacccuuuuaugucuuua

SEQ ID NO: 53980 - RNA, 20 nt, Artificial Sequence
  CIITA targeting sequence
uuuuccuccacccuuuuaug

SEQ ID NO: 53981 - RNA, 20 nt, Artificial Sequence
  CIITA targeting sequence
cuccuuuuccuccacccuuu

SEQ ID NO: 53982 - RNA, 20 nt, Artificial Sequence
  CIITA targeting sequence
cgcuccuuuuccuccacccu

SEQ ID NO: 53983 - RNA, 20 nt, Artificial Sequence
  CIITA targeting sequence
gcugucucgcuccuuuuccu

SEQ ID NO: 53984 - RNA, 20 nt, Artificial Sequence
  CIITA targeting sequence
aaaaaacgauucaugugguu

SEQ ID NO: 53985 - RNA, 20 nt, Artificial Sequence
  CIITA targeting sequence
uuuuuuggacucggcugucu

SEQ ID NO: 53986 - RNA, 20 nt, Artificial Sequence
  CIITA targeting sequence
ugugguuugggcagaaucug

SEQ ID NO: 53987 - RNA, 20 nt, Artificial Sequence
  CIITA targeting sequence
gcccaaaccacaugaaucgu

SEQ ID NO: 53988 - RNA, 20 nt, Artificial Sequence
  CIITA targeting sequence
gaaaugagaguccuuugaga

SEQ ID NO: 53989 - RNA, 20 nt, Artificial Sequence
  CIITA targeting sequence
gauucugcccaaaccacaug

SEQ ID NO: 53990 - RNA, 20 nt, Artificial Sequence
  CIITA targeting sequence
uuucagauucugcccaaacc

SEQ ID NO: 53991 - RNA, 20 nt, Artificial Sequence
  CIITA targeting sequence
cauuucagauucugcccaaa

SEQ ID NO: 53992 - RNA, 20 nt, Artificial Sequence
  CIITA targeting sequence
uuugagauugacugaacguc

SEQ ID NO: 53993 - RNA, 20 nt, Artificial Sequence
  CIITA targeting sequence
aaggacucucauuucagauu

SEQ ID NO: 53994 - RNA, 20 nt, Artificial Sequence
  CIITA targeting sequence
caaaggacucucauuucaga

SEQ ID NO: 53995 - RNA, 20 nt, Artificial Sequence
  CIITA targeting sequence
aucucaaaggacucucauuu

SEQ ID NO: 53996 - RNA, 20 nt, Artificial Sequence
  CIITA targeting sequence
gucaaucucaaaggacucuc

SEQ ID NO: 53997 - RNA, 20 nt, Artificial Sequence
  CIITA targeting sequence
cuugauaaagaaagcaaguu

SEQ ID NO: 53998 - RNA, 20 nt, Artificial Sequence
  CIITA targeting sequence
ugauaaagaaagcaaguuca

SEQ ID NO: 53999 - RNA, 20 nt, Artificial Sequence
  CIITA targeting sequence
agagacguucagucaaucuc

SEQ ID NO: 54000 - RNA, 20 nt, Artificial Sequence
  CIITA targeting sequence
uuaucaagagacguucaguc

SEQ ID NO: 54001 - RNA, 20 nt, Artificial Sequence
  CIITA targeting sequence
gcugggcguguugguucaug

SEQ ID NO: 54002 - RNA, 20 nt, Artificial Sequence
  CIITA targeting sequence
ugccugaaaucccagcacuu

SEQ ID NO: 54003 - RNA, 20 nt, Artificial Sequence
  CIITA targeting sequence
ggcaugaaccaacacgccca

SEQ ID NO: 54004 - RNA, 20 nt, Artificial Sequence
  CIITA targeting sequence
cagcacuuugggagguugag

SEQ ID NO: 54005 - RNA, 20 nt, Artificial Sequence
  CIITA targeting sequence
caaagugcugggauuucagg

SEQ ID NO: 54006 - RNA, 20 nt, Artificial Sequence
  CIITA targeting sequence
accucccaaagugcugggau

SEQ ID NO: 54007 - RNA, 20 nt, Artificial Sequence
  CIITA targeting sequence
gcccgccucaaccucccaaa

SEQ ID NO: 54008 - RNA, 20 nt, Artificial Sequence
  CIITA targeting sequence
ccuggggucaggaguucaag

SEQ ID NO: 54009 - RNA, 20 nt, Artificial Sequence
  CIITA targeting sequence
ggaguucaagaccagccugg

SEQ ID NO: 54010 - RNA, 20 nt, Artificial Sequence
  CIITA targeting sequence
ugaccccaggugaucugccc

SEQ ID NO: 54011 - RNA, 20 nt, Artificial Sequence
  CIITA targeting sequence
agaccagccuggccaacaug

SEQ ID NO: 54012 - RNA, 20 nt, Artificial Sequence
  CIITA targeting sequence
ugaacuccugaccccaggug

SEQ ID NO: 54013 - RNA, 20 nt, Artificial Sequence
  CIITA targeting sequence
ccauguuggccaggcugguc

SEQ ID NO: 54014 - RNA, 20 nt, Artificial Sequence
  CIITA targeting sequence
cuacuaaaaauacaaaaaau

SEQ ID NO: 54015 - RNA, 20 nt, Artificial Sequence
  CIITA targeting sequence
acuaaaaauacaaaaaauua

SEQ ID NO: 54016 - RNA, 20 nt, Artificial Sequence
  CIITA targeting sequence
ccacacccggcuaauuuuuu

SEQ ID NO: 54017 - RNA, 20 nt, Artificial Sequence
  CIITA targeting sequence
guggucccagcuacuuggga

SEQ ID NO: 54018 - RNA, 20 nt, Artificial Sequence
  CIITA targeting sequence
cagcuacuugggaggccgag

SEQ ID NO: 54019 - RNA, 20 nt, Artificial Sequence
  CIITA targeting sequence
caaguagcugggaccacaga

SEQ ID NO: 54020 - RNA, 20 nt, Artificial Sequence
  CIITA targeting sequence
gccucccaaguagcugggac

SEQ ID NO: 54021 - RNA, 20 nt, Artificial Sequence
  CIITA targeting sequence
ugccucggccucccaaguag

SEQ ID NO: 54022 - RNA, 20 nt, Artificial Sequence
  CIITA targeting sequence
ccugccucggccucccaagu

SEQ ID NO: 54023 - RNA, 20 nt, Artificial Sequence
  CIITA targeting sequence
cuugaaccugggagauggag

SEQ ID NO: 54024 - RNA, 20 nt, Artificial Sequence
  CIITA targeting sequence
agcgauucuccugccucggc

SEQ ID NO: 54025 - RNA, 20 nt, Artificial Sequence
  CIITA targeting sequence
cagguucaagcgauucuccu

SEQ ID NO: 54026 - RNA, 20 nt, Artificial Sequence
  CIITA targeting sequence
cccagguucaagcgauucuc

SEQ ID NO: 54027 - RNA, 20 nt, Artificial Sequence
  CIITA targeting sequence
aucucccagguucaagcgau

SEQ ID NO: 54028 - RNA, 20 nt, Artificial Sequence
  CIITA targeting sequence
cugcaaccuccaucucccag

SEQ ID NO: 54029 - RNA, 20 nt, Artificial Sequence
  CIITA targeting sequence
acucacugcaaccuccaucu

SEQ ID NO: 54030 - RNA, 20 nt, Artificial Sequence
  CIITA targeting sequence
cuacucacugcaaccuccau

SEQ ID NO: 54031 - RNA, 20 nt, Artificial Sequence
  CIITA targeting sequence
cgccacugcacuccaggcug

SEQ ID NO: 54032 - RNA, 20 nt, Artificial Sequence
  CIITA targeting sequence
aggcugggugacagagaaaa

SEQ ID NO: 54033 - RNA, 20 nt, Artificial Sequence
  CIITA targeting sequence
cccagccuggagugcagugg

SEQ ID NO: 54034 - RNA, 20 nt, Artificial Sequence
  CIITA targeting sequence
gucacccagccuggagugca

SEQ ID NO: 54035 - RNA, 20 nt, Artificial Sequence
  CIITA targeting sequence
cugucacccagccuggagug

SEQ ID NO: 54036 - RNA, 20 nt, Artificial Sequence
  CIITA targeting sequence
gucucaauaaaauaaaauaa

SEQ ID NO: 54037 - RNA, 20 nt, Artificial Sequence
  CIITA targeting sequence
caauaaaauaaaauaaaaua

SEQ ID NO: 54038 - RNA, 20 nt, Artificial Sequence
  CIITA targeting sequence
auaaaauaaaauaaaauaaa

SEQ ID NO: 54039 - RNA, 20 nt, Artificial Sequence
  CIITA targeting sequence
uuuauuuuuauuuuauuuua

SEQ ID NO: 54040 - RNA, 20 nt, Artificial Sequence
  CIITA targeting sequence
gcuaagaguuaagugccagg

SEQ ID NO: 54041 - RNA, 20 nt, Artificial Sequence
  CIITA targeting sequence
uagcugaauuugcauucuuu

SEQ ID NO: 54042 - RNA, 20 nt, Artificial Sequence
  CIITA targeting sequence
agcacaggcccuggcacuua

SEQ ID NO: 54043 - RNA, 20 nt, Artificial Sequence
  CIITA targeting sequence
caugagucgcuucauuuuac

SEQ ID NO: 54044 - RNA, 20 nt, Artificial Sequence
  CIITA targeting sequence
ugagucgcuucauuuuacug

SEQ ID NO: 54045 - RNA, 20 nt, Artificial Sequence
  CIITA targeting sequence
ugagacggcuuccagcacag

SEQ ID NO: 54046 - RNA, 20 nt, Artificial Sequence
  CIITA targeting sequence
cuucauuuuacugucccagu

SEQ ID NO: 54047 - RNA, 20 nt, Artificial Sequence
  CIITA targeting sequence
uuuuacugucccaguacgcc

SEQ ID NO: 54048 - RNA, 20 nt, Artificial Sequence
  CIITA targeting sequence
caguacgccugggaggucug

SEQ ID NO: 54049 - RNA, 20 nt, Artificial Sequence
  CIITA targeting sequence
caggcguacugggacaguaa

SEQ ID NO: 54050 - RNA, 20 nt, Artificial Sequence
  CIITA targeting sequence
guuucccauccccuuucaca

SEQ ID NO: 54051 - RNA, 20 nt, Artificial Sequence
  CIITA targeting sequence
cauccccuuucacagcugug

SEQ ID NO: 54052 - RNA, 20 nt, Artificial Sequence
  CIITA targeting sequence
ccuuucacagcugugaaaac

SEQ ID NO: 54053 - RNA, 20 nt, Artificial Sequence
  CIITA targeting sequence
cagcugugaaaaccgcagcc

SEQ ID NO: 54054 - RNA, 20 nt, Artificial Sequence
  CIITA targeting sequence
cagcugugaaaggggauggg

SEQ ID NO: 54055 - RNA, 20 nt, Artificial Sequence
  CIITA targeting sequence
guggcugcgguuuucacagc

SEQ ID NO: 54056 - RNA, 20 nt, Artificial Sequence
  CIITA targeting sequence
ccguggcugcgguuuucaca

SEQ ID NO: 54057 - RNA, 20 nt, Artificial Sequence
  CIITA targeting sequence
ucuccguggcugcgguuuuc

SEQ ID NO: 54058 - RNA, 20 nt, Artificial Sequence
  CIITA targeting sequence
uuuuuccaggggcaucuacc

SEQ ID NO: 54059 - RNA, 20 nt, Artificial Sequence
  CIITA targeting sequence
aggggcaucuaccuggcagc

SEQ ID NO: 54060 - RNA, 20 nt, Artificial Sequence
  CIITA targeting sequence
accuggcagccgaagagcca

SEQ ID NO: 54061 - RNA, 20 nt, Artificial Sequence
  CIITA targeting sequence
gcugccagguagaugccccu

SEQ ID NO: 54062 - RNA, 20 nt, Artificial Sequence
  CIITA targeting sequence
ucggcugccagguagaugcc

SEQ ID NO: 54063 - RNA, 20 nt, Artificial Sequence
  CIITA targeting sequence
ccaccuggcucuucggcugc

SEQ ID NO: 54064 - RNA, 20 nt, Artificial Sequence
  CIITA targeting sequence
uuaagggcacuguuguugug

SEQ ID NO: 54065 - RNA, 20 nt, Artificial Sequence
  CIITA targeting sequence
uggccacccacaacaacagu

SEQ ID NO: 54066 - RNA, 20 nt, Artificial Sequence
  CIITA targeting sequence
cuagggcagcucuuccccag

SEQ ID NO: 54067 - RNA, 20 nt, Artificial Sequence
  CIITA targeting sequence
uccccagggcagcucuggga

SEQ ID NO: 54068 - RNA, 20 nt, Artificial Sequence
  CIITA targeting sequence
ccagggcagcucugggagcu

SEQ ID NO: 54069 - RNA, 20 nt, Artificial Sequence
  CIITA targeting sequence
gggagcugauggucucuaca

SEQ ID NO: 54070 - RNA, 20 nt, Artificial Sequence
  CIITA targeting sequence
cagagcugcccuggggaaga

SEQ ID NO: 54071 - RNA, 20 nt, Artificial Sequence
  CIITA targeting sequence
gcucccagagcugcccuggg

SEQ ID NO: 54072 - RNA, 20 nt, Artificial Sequence
  CIITA targeting sequence
cuacacgggcgcuggccccc

SEQ ID NO: 54073 - RNA, 20 nt, Artificial Sequence
  CIITA targeting sequence
acacgggcgcuggccccccc

SEQ ID NO: 54074 - RNA, 20 nt, Artificial Sequence
  CIITA targeting sequence
augcacagaaaaugggauga

SEQ ID NO: 54075 - RNA, 20 nt, Artificial Sequence
  CIITA targeting sequence
gugcauagaccagcaggggg

SEQ ID NO: 54076 - RNA, 20 nt, Artificial Sequence
  CIITA targeting sequence
cauuuucugugcauagacca

SEQ ID NO: 54077 - RNA, 20 nt, Artificial Sequence
  CIITA targeting sequence
ucccauuuucugugcauaga

SEQ ID NO: 54078 - RNA, 20 nt, Artificial Sequence
  CIITA targeting sequence
ccagaaaacaagggcacaga

SEQ ID NO: 54079 - RNA, 20 nt, Artificial Sequence
  CIITA targeting sequence
ggugacggguugucauccca

SEQ ID NO: 54080 - RNA, 20 nt, Artificial Sequence
  CIITA targeting sequence
gugcccuuguuuucugguga

SEQ ID NO: 54081 - RNA, 20 nt, Artificial Sequence
  CIITA targeting sequence
auucugugcccuuguuuucu

SEQ ID NO: 54082 - RNA, 20 nt, Artificial Sequence
  CIITA targeting sequence
uuugcuccauucugugcccu

SEQ ID NO: 54083 - RNA, 20 nt, Artificial Sequence
  CIITA targeting sequence
uggccccauuuuguuccuuu

SEQ ID NO: 54084 - RNA, 20 nt, Artificial Sequence
  CIITA targeting sequence
cauggccccauuuuguuccu

SEQ ID NO: 54085 - RNA, 20 nt, Artificial Sequence
  CIITA targeting sequence
ccccugucuacccaggaguu

SEQ ID NO: 54086 - RNA, 20 nt, Artificial Sequence
  CIITA targeting sequence
acccaggaguucugcccauu

SEQ ID NO: 54087 - RNA, 20 nt, Artificial Sequence
  CIITA targeting sequence
uggguagacaggggugaagu

SEQ ID NO: 54088 - RNA, 20 nt, Artificial Sequence
  CIITA targeting sequence
gcccauuauggccaagccca

SEQ ID NO: 54089 - RNA, 20 nt, Artificial Sequence
  CIITA targeting sequence
ccacccccaccugggcuugg

SEQ ID NO: 54090 - RNA, 20 nt, Artificial Sequence
  CIITA targeting sequence
ccccacccccaccugggcuu

SEQ ID NO: 54091 - RNA, 20 nt, Artificial Sequence
  CIITA targeting sequence
agcacucuccccacccccac

SEQ ID NO: 54092 - RNA, 20 nt, Artificial Sequence
  CIITA targeting sequence
gguugccaaauccagcacuc

SEQ ID NO: 54093 - RNA, 20 nt, Artificial Sequence
  CIITA targeting sequence
gaggggcuugcaguggggcc

SEQ ID NO: 54094 - RNA, 20 nt, Artificial Sequence
  CIITA targeting sequence
gaacccaucugguugccaaa

SEQ ID NO: 54095 - RNA, 20 nt, Artificial Sequence
  CIITA targeting sequence
uucaguggaugaccuugggu

SEQ ID NO: 54096 - RNA, 20 nt, Artificial Sequence
  CIITA targeting sequence
guggaugaccuugggugggu

SEQ ID NO: 54097 - RNA, 20 nt, Artificial Sequence
  CIITA targeting sequence
acugaaugaacaguggggcu

SEQ ID NO: 54098 - RNA, 20 nt, Artificial Sequence
  CIITA targeting sequence
uccacugaaugaacaguggg

SEQ ID NO: 54099 - RNA, 20 nt, Artificial Sequence
  CIITA targeting sequence
cugcccuucugauauccaua

SEQ ID NO: 54100 - RNA, 20 nt, Artificial Sequence
  CIITA targeting sequence
gauauccauagagaagggau

SEQ ID NO: 54101 - RNA, 20 nt, Artificial Sequence
  CIITA targeting sequence
gaagggcagugaaaauaacc

SEQ ID NO: 54102 - RNA, 20 nt, Artificial Sequence
  CIITA targeting sequence
auagagaagggaugacgugg

SEQ ID NO: 54103 - RNA, 20 nt, Artificial Sequence
  CIITA targeting sequence
auggauaucagaagggcagu

SEQ ID NO: 54104 - RNA, 20 nt, Artificial Sequence
  CIITA targeting sequence
cuauggauaucagaagggca

SEQ ID NO: 54105 - RNA, 20 nt, Artificial Sequence
  CIITA targeting sequence
cuucucuauggauaucagaa

SEQ ID NO: 54106 - RNA, 20 nt, Artificial Sequence
  CIITA targeting sequence
ucccuucucuauggauauca

SEQ ID NO: 54107 - RNA, 20 nt, Artificial Sequence
  CIITA targeting sequence
gagagguuaaauaauucguc

SEQ ID NO: 54108 - RNA, 20 nt, Artificial Sequence
  CIITA targeting sequence
gaccccacgucaucccuucu

SEQ ID NO: 54109 - RNA, 20 nt, Artificial Sequence
  CIITA targeting sequence
cugaccccacgucaucccuu

SEQ ID NO: 54110 - RNA, 20 nt, Artificial Sequence
  CIITA targeting sequence
ucugcaugacuguuaacugg

SEQ ID NO: 54111 - RNA, 20 nt, Artificial Sequence
  CIITA targeting sequence
gcaugacuguuaacuggaau

SEQ ID NO: 54112 - RNA, 20 nt, Artificial Sequence
  CIITA targeting sequence
ugcagacgaauuauuuaacc

SEQ ID NO: 54113 - RNA, 20 nt, Artificial Sequence
  CIITA targeting sequence
aguuaacagucaugcagacg

SEQ ID NO: 54114 - RNA, 20 nt, Artificial Sequence
  CIITA targeting sequence
ggugcuucaaaguucacuuu

SEQ ID NO: 54115 - RNA, 20 nt, Artificial Sequence
  CIITA targeting sequence
aaguucacuuuaguggccuu

SEQ ID NO: 54116 - RNA, 20 nt, Artificial Sequence
  CIITA targeting sequence
cuuuaguggccuuucugucg

SEQ ID NO: 54117 - RNA, 20 nt, Artificial Sequence
  CIITA targeting sequence
gucgccaagcaccugcuggg

SEQ ID NO: 54118 - RNA, 20 nt, Artificial Sequence
  CIITA targeting sequence
ccaagcaccugcuggguucc

SEQ ID NO: 54119 - RNA, 20 nt, Artificial Sequence
  CIITA targeting sequence
agacucuggauacacgaggu

SEQ ID NO: 54120 - RNA, 20 nt, Artificial Sequence
  CIITA targeting sequence
ggaacccagcaggugcuugg

SEQ ID NO: 54121 - RNA, 20 nt, Artificial Sequence
  CIITA targeting sequence
ggauacacgaggugaaggag

SEQ ID NO: 54122 - RNA, 20 nt, Artificial Sequence
  CIITA targeting sequence
agagucuggaacccagcagg

SEQ ID NO: 54123 - RNA, 20 nt, Artificial Sequence
  CIITA targeting sequence
uguauccagagucuggaacc

SEQ ID NO: 54124 - RNA, 20 nt, Artificial Sequence
  CIITA targeting sequence
ccucguguauccagagucug

SEQ ID NO: 54125 - RNA, 20 nt, Artificial Sequence
  CIITA targeting sequence
uucaccucguguauccagag

SEQ ID NO: 54126 - RNA, 20 nt, Artificial Sequence
  CIITA targeting sequence
ccuucaccucguguauccag

SEQ ID NO: 54127 - RNA, 20 nt, Artificial Sequence
  CIITA targeting sequence
ucuuggaccucccauuccuc

SEQ ID NO: 54128 - RNA, 20 nt, Artificial Sequence
  CIITA targeting sequence
uggaccucccauuccuccuu

SEQ ID NO: 54129 - RNA, 20 nt, Artificial Sequence
  CIITA targeting sequence
aagaagauaccaugcacaca

SEQ ID NO: 54130 - RNA, 20 nt, Artificial Sequence
  CIITA targeting sequence
cauuccuccuuaucguuccu

SEQ ID NO: 54131 - RNA, 20 nt, Artificial Sequence
  CIITA targeting sequence
uccuuaucguuccuguuuua

SEQ ID NO: 54132 - RNA, 20 nt, Artificial Sequence
  CIITA targeting sequence
uuaucguuccuguuuuaagc

SEQ ID NO: 54133 - RNA, 20 nt, Artificial Sequence
  CIITA targeting sequence
uuccuguuuuaagcccgagg

SEQ ID NO: 54134 - RNA, 20 nt, Artificial Sequence
  CIITA targeting sequence
uguuuuaagcccgaggaagu

SEQ ID NO: 54135 - RNA, 20 nt, Artificial Sequence
  CIITA targeting sequence
ggcuuaaaacaggaacgaua

SEQ ID NO: 54136 - RNA, 20 nt, Artificial Sequence
  CIITA targeting sequence
ucgggcuuaaaacaggaacg

SEQ ID NO: 54137 - RNA, 20 nt, Artificial Sequence
  CIITA targeting sequence
ugugcuuuuaagaacuugug

SEQ ID NO: 54138 - RNA, 20 nt, Artificial Sequence
  CIITA targeting sequence
uaaaagcacaggacuuccuc

SEQ ID NO: 54139 - RNA, 20 nt, Artificial Sequence
  CIITA targeting sequence
aaccgcacaaguucuuaaaa

SEQ ID NO: 54140 - RNA, 20 nt, Artificial Sequence
  CIITA targeting sequence
ccuggguaucgaagcuaauc

SEQ ID NO: 54141 - RNA, 20 nt, Artificial Sequence
  CIITA targeting sequence
aagcuaaucuccccauccca

SEQ ID NO: 54142 - RNA, 20 nt, Artificial Sequence
  CIITA targeting sequence
auacccaggugagcccaauc

SEQ ID NO: 54143 - RNA, 20 nt, Artificial Sequence
  CIITA targeting sequence
ccccaucccaaugcccugac

SEQ ID NO: 54144 - RNA, 20 nt, Artificial Sequence
  CIITA targeting sequence
ccaucccaaugcccugacua

SEQ ID NO: 54145 - RNA, 20 nt, Artificial Sequence
  CIITA targeting sequence
caaugcccugacuaauccca

SEQ ID NO: 54146 - RNA, 20 nt, Artificial Sequence
  CIITA targeting sequence
gggcauugggauggggagau

SEQ ID NO: 54147 - RNA, 20 nt, Artificial Sequence
  CIITA targeting sequence
caucugcaaagucccuuuug

SEQ ID NO: 54148 - RNA, 20 nt, Artificial Sequence
  CIITA targeting sequence
gcaaagucccuuuugcuacg

SEQ ID NO: 54149 - RNA, 20 nt, Artificial Sequence
  CIITA targeting sequence
cuuuugcuacguaaggugua

SEQ ID NO: 54150 - RNA, 20 nt, Artificial Sequence
  CIITA targeting sequence
uacaccuuacguagcaaaag

SEQ ID NO: 54151 - RNA, 20 nt, Artificial Sequence
  CIITA targeting sequence
gagguucuggggauuagggc

SEQ ID NO: 54152 - RNA, 20 nt, Artificial Sequence
  CIITA targeting sequence
gaauaucauacaccuuacgu

SEQ ID NO: 54153 - RNA, 20 nt, Artificial Sequence
  CIITA targeting sequence
ggggauuagggcguggacau

SEQ ID NO: 54154 - RNA, 20 nt, Artificial Sequence
  CIITA targeting sequence
ccagaaccucugaauaucau

SEQ ID NO: 54155 - RNA, 20 nt, Artificial Sequence
  CIITA targeting sequence
acgcccuaauccccagaacc

SEQ ID NO: 54156 - RNA, 20 nt, Artificial Sequence
  CIITA targeting sequence
uuguguggggagggacauuc

SEQ ID NO: 54157 - RNA, 20 nt, Artificial Sequence
  CIITA targeting sequence
ccacacaacgauguccacgc

SEQ ID NO: 54158 - RNA, 20 nt, Artificial Sequence
  CIITA targeting sequence
cuccccacacaacgaugucc

SEQ ID NO: 54159 - RNA, 20 nt, Artificial Sequence
  CIITA targeting sequence
gccuacuagaccccaaagau

SEQ ID NO: 54160 - RNA, 20 nt, Artificial Sequence
  CIITA targeting sequence
aguaggcagaaugucccucc

SEQ ID NO: 54161 - RNA, 20 nt, Artificial Sequence
  CIITA targeting sequence
uuggggucuaguaggcagaa

SEQ ID NO: 54162 - RNA, 20 nt, Artificial Sequence
  CIITA targeting sequence
uaccaaauacaaaauacauu

SEQ ID NO: 54163 - RNA, 20 nt, Artificial Sequence
  CIITA targeting sequence
cccugccccaaggucucauc

SEQ ID NO: 54164 - RNA, 20 nt, Artificial Sequence
  CIITA targeting sequence
caucccauuauaacaucaac

SEQ ID NO: 54165 - RNA, 20 nt, Artificial Sequence
  CIITA targeting sequence
ucccauuauaacaucaacug

SEQ ID NO: 54166 - RNA, 20 nt, Artificial Sequence
  CIITA targeting sequence
cauuauaacaucaacugaag

SEQ ID NO: 54167 - RNA, 20 nt, Artificial Sequence
  CIITA targeting sequence
acugaagagucccaaaucug

SEQ ID NO: 54168 - RNA, 20 nt, Artificial Sequence
  CIITA targeting sequence
guugauguuauaaugggaug

SEQ ID NO: 54169 - RNA, 20 nt, Artificial Sequence
  CIITA targeting sequence
ucaguugauguuauaauggg

SEQ ID NO: 54170 - RNA, 20 nt, Artificial Sequence
  CIITA targeting sequence
caaaucugcucucaaucucg

SEQ ID NO: 54171 - RNA, 20 nt, Artificial Sequence
  CIITA targeting sequence
gcucucaaucucgucaccua

SEQ ID NO: 54172 - RNA, 20 nt, Artificial Sequence
  CIITA targeting sequence
caaucucgucaccuaaucac

SEQ ID NO: 54173 - RNA, 20 nt, Artificial Sequence
  CIITA targeting sequence
aucucgucaccuaaucaccu

SEQ ID NO: 54174 - RNA, 20 nt, Artificial Sequence
  CIITA targeting sequence
cgucaccuaaucaccucaau

SEQ ID NO: 54175 - RNA, 20 nt, Artificial Sequence
  CIITA targeting sequence
ucaccuaaucaccucaaucu

SEQ ID NO: 54176 - RNA, 20 nt, Artificial Sequence
  CIITA targeting sequence
ccuaaucaccucaaucuggu

SEQ ID NO: 54177 - RNA, 20 nt, Artificial Sequence
  CIITA targeting sequence
ccucaaucuggugcugcgga

SEQ ID NO: 54178 - RNA, 20 nt, Artificial Sequence
  CIITA targeting sequence
aucuggugcugcggaggcuu

SEQ ID NO: 54179 - RNA, 20 nt, Artificial Sequence
  CIITA targeting sequence
ggugcugcggaggcuuuggg

SEQ ID NO: 54180 - RNA, 20 nt, Artificial Sequence
  CIITA targeting sequence
gcagcaccagauugagguga

SEQ ID NO: 54181 - RNA, 20 nt, Artificial Sequence
  CIITA targeting sequence
uacccaaagccuccgcagca

SEQ ID NO: 54182 - RNA, 20 nt, Artificial Sequence
  CIITA targeting sequence
ugagcaguucgucucccucu

SEQ ID NO: 54183 - RNA, 20 nt, Artificial Sequence
  CIITA targeting sequence
ggaugggucauacccaaagc

SEQ ID NO: 54184 - RNA, 20 nt, Artificial Sequence
  CIITA targeting sequence
ucucccucugugaaccugga

SEQ ID NO: 54185 - RNA, 20 nt, Artificial Sequence
  CIITA targeting sequence
cccucugugaaccuggaacu

SEQ ID NO: 54186 - RNA, 20 nt, Artificial Sequence
  CIITA targeting sequence
cucugugaaccuggaacuca

SEQ ID NO: 54187 - RNA, 20 nt, Artificial Sequence
  CIITA targeting sequence
gugaaccuggaacucacuaa

SEQ ID NO: 54188 - RNA, 20 nt, Artificial Sequence
  CIITA targeting sequence
cagagggagacgaacugcuc

SEQ ID NO: 54189 - RNA, 20 nt, Artificial Sequence
  CIITA targeting sequence
agguucacagagggagacga

SEQ ID NO: 54190 - RNA, 20 nt, Artificial Sequence
  CIITA targeting sequence
cuaaaccaguuaccaggccc

SEQ ID NO: 54191 - RNA, 20 nt, Artificial Sequence
  CIITA targeting sequence
agguggccacccacugcacu

SEQ ID NO: 54192 - RNA, 20 nt, Artificial Sequence
  CIITA targeting sequence
ucuagguggccacccacugc

SEQ ID NO: 54193 - RNA, 20 nt, Artificial Sequence
  CIITA targeting sequence
aguucugucccugauccaag

SEQ ID NO: 54194 - RNA, 20 nt, Artificial Sequence
  CIITA targeting sequence
gucccugauccaagggaccu

SEQ ID NO: 54195 - RNA, 20 nt, Artificial Sequence
  CIITA targeting sequence
cugauccaagggaccugaga

SEQ ID NO: 54196 - RNA, 20 nt, Artificial Sequence
  CIITA targeting sequence
gggacagaacuagauugugc

SEQ ID NO: 54197 - RNA, 20 nt, Artificial Sequence
  CIITA targeting sequence
aagggaccugagauguaaua

SEQ ID NO: 54198 - RNA, 20 nt, Artificial Sequence
  CIITA targeting sequence
cuuggaucagggacagaacu

SEQ ID NO: 54199 - RNA, 20 nt, Artificial Sequence
  CIITA targeting sequence
ggucccuuggaucagggaca

SEQ ID NO: 54200 - RNA, 20 nt, Artificial Sequence
  CIITA targeting sequence
caggucccuuggaucaggga

SEQ ID NO: 54201 - RNA, 20 nt, Artificial Sequence
  CIITA targeting sequence
ugcccauauuacaucucagg

SEQ ID NO: 54202 - RNA, 20 nt, Artificial Sequence
  CIITA targeting sequence
uucuugcccauauuacaucu

SEQ ID NO: 54203 - RNA, 20 nt, Artificial Sequence
  CIITA targeting sequence
uuuucuuucuugcccauauu

SEQ ID NO: 54204 - RNA, 20 nt, Artificial Sequence
  CIITA targeting sequence
uccuuuucuuucuugcccau

SEQ ID NO: 54205 - RNA, 20 nt, Artificial Sequence
  CIITA targeting sequence
uuguuucuuccuuuucuuuc

SEQ ID NO: 54206 - RNA, 20 nt, Artificial Sequence
  CIITA targeting sequence
ggguguacagccucauuguu

SEQ ID NO: 54207 - RNA, 20 nt, Artificial Sequence
  CIITA targeting sequence
cuuccuccugcucacacagg

SEQ ID NO: 54208 - RNA, 20 nt, Artificial Sequence
  CIITA targeting sequence
uccugcucacacaggacagg

SEQ ID NO: 54209 - RNA, 20 nt, Artificial Sequence
  CIITA targeting sequence
ugcucacacaggacagggaa

SEQ ID NO: 54210 - RNA, 20 nt, Artificial Sequence
  CIITA targeting sequence
cacaggacagggaaaggagu

SEQ ID NO: 54211 - RNA, 20 nt, Artificial Sequence
  CIITA targeting sequence
ugugugagcaggaggaaggg

SEQ ID NO: 54212 - RNA, 20 nt, Artificial Sequence
  CIITA targeting sequence
cuguccugugugagcaggag

SEQ ID NO: 54213 - RNA, 20 nt, Artificial Sequence
  CIITA targeting sequence
uuucccuguccugugugagc

SEQ ID NO: 54214 - RNA, 20 nt, Artificial Sequence
  CIITA targeting sequence
ccaaagggccugucagcacc

SEQ ID NO: 54215 - RNA, 20 nt, Artificial Sequence
  CIITA targeting sequence
aaagggccugucagcaccga

SEQ ID NO: 54216 - RNA, 20 nt, Artificial Sequence
  CIITA targeting sequence
gcaccgaauuccacauccug

SEQ ID NO: 54217 - RNA, 20 nt, Artificial Sequence
  CIITA targeting sequence
gugcugacaggcccuuugga

SEQ ID NO: 54218 - RNA, 20 nt, Artificial Sequence
  CIITA targeting sequence
acauccugugagcuugggaa

SEQ ID NO: 54219 - RNA, 20 nt, Artificial Sequence
  CIITA targeting sequence
ugugagcuugggaagaugcc

SEQ ID NO: 54220 - RNA, 20 nt, Artificial Sequence
  CIITA targeting sequence
caggauguggaauucggugc

SEQ ID NO: 54221 - RNA, 20 nt, Artificial Sequence
  CIITA targeting sequence
caagcucacaggauguggaa

SEQ ID NO: 54222 - RNA, 20 nt, Artificial Sequence
  CIITA targeting sequence
ucccaagcucacaggaugug

SEQ ID NO: 54223 - RNA, 20 nt, Artificial Sequence
  CIITA targeting sequence
uccagcggguacugcucauu

SEQ ID NO: 54224 - RNA, 20 nt, Artificial Sequence
  CIITA targeting sequence
agcggguacugcucauuuua

SEQ ID NO: 54225 - RNA, 20 nt, Artificial Sequence
  CIITA targeting sequence
uuuuagaaagugagucaguc

SEQ ID NO: 54226 - RNA, 20 nt, Artificial Sequence
  CIITA targeting sequence
aaaaugagcaguacccgcug

SEQ ID NO: 54227 - RNA, 20 nt, Artificial Sequence
  CIITA targeting sequence
cuuucuaaaaugagcaguac

SEQ ID NO: 54228 - RNA, 20 nt, Artificial Sequence
  CIITA targeting sequence
gucugggcgugguggcucac

SEQ ID NO: 54229 - RNA, 20 nt, Artificial Sequence
  CIITA targeting sequence
gggcgugguggcucacagcc

SEQ ID NO: 54230 - RNA, 20 nt, Artificial Sequence
  CIITA targeting sequence
cagccguagucccagcacuu

SEQ ID NO: 54231 - RNA, 20 nt, Artificial Sequence
  CIITA targeting sequence
cagcacuuuggguggccgag

SEQ ID NO: 54232 - RNA, 20 nt, Artificial Sequence
  CIITA targeting sequence
gccacccaaagugcugggac

SEQ ID NO: 54233 - RNA, 20 nt, Artificial Sequence
  CIITA targeting sequence
acccgccucggccacccaaa

SEQ ID NO: 54234 - RNA, 20 nt, Artificial Sequence
  CIITA targeting sequence
ccugaagccaggaauuugug

SEQ ID NO: 54235 - RNA, 20 nt, Artificial Sequence
  CIITA targeting sequence
ggugauccacccgccucggc

SEQ ID NO: 54236 - RNA, 20 nt, Artificial Sequence
  CIITA targeting sequence
uggcuucaggugauccaccc

SEQ ID NO: 54237 - RNA, 20 nt, Artificial Sequence
  CIITA targeting sequence
caaauuccuggcuucaggug

SEQ ID NO: 54238 - RNA, 20 nt, Artificial Sequence
  CIITA targeting sequence
cuaccaaaaauagaaaaauu

SEQ ID NO: 54239 - RNA, 20 nt, Artificial Sequence
  CIITA targeting sequence
accaaaaauagaaaaauuag

SEQ ID NO: 54240 - RNA, 20 nt, Artificial Sequence
  CIITA targeting sequence
auuuuugguagagacagggu

SEQ ID NO: 54241 - RNA, 20 nt, Artificial Sequence
  CIITA targeting sequence
cagcuacuugggaggcugag

SEQ ID NO: 54242 - RNA, 20 nt, Artificial Sequence
  CIITA targeting sequence
caaguagcugggaccacagg

SEQ ID NO: 54243 - RNA, 20 nt, Artificial Sequence
  CIITA targeting sequence
gccucccaaguagcugggac

SEQ ID NO: 54244 - RNA, 20 nt, Artificial Sequence
  CIITA targeting sequence
ugccucagccucccaaguag

SEQ ID NO: 54245 - RNA, 20 nt, Artificial Sequence
  CIITA targeting sequence
ccugccucagccucccaagu

SEQ ID NO: 54246 - RNA, 20 nt, Artificial Sequence
  CIITA targeting sequence
cuugaacccaggaggcggag

SEQ ID NO: 54247 - RNA, 20 nt, Artificial Sequence
  CIITA targeting sequence
agugauucuccugccucagc

SEQ ID NO: 54248 - RNA, 20 nt, Artificial Sequence
  CIITA targeting sequence
uggguucaagugauucuccu

SEQ ID NO: 54249 - RNA, 20 nt, Artificial Sequence
  CIITA targeting sequence
gccuccuggguucaagugau

SEQ ID NO: 54250 - RNA, 20 nt, Artificial Sequence
  CIITA targeting sequence
ccgcaaccuccgccuccugg

SEQ ID NO: 54251 - RNA, 20 nt, Artificial Sequence
  CIITA targeting sequence
gcucaccgcaaccuccgccu

SEQ ID NO: 54252 - RNA, 20 nt, Artificial Sequence
  CIITA targeting sequence
cggcucaccgcaaccuccgc

SEQ ID NO: 54253 - RNA, 20 nt, Artificial Sequence
  CIITA targeting sequence
uuccacugcacuccagccug

SEQ ID NO: 54254 - RNA, 20 nt, Artificial Sequence
  CIITA targeting sequence
acugcacuccagccugggug

SEQ ID NO: 54255 - RNA, 20 nt, Artificial Sequence
  CIITA targeting sequence
agccugggugacagagugcc

SEQ ID NO: 54256 - RNA, 20 nt, Artificial Sequence
  CIITA targeting sequence
cccaggcuggagugcagugg

SEQ ID NO: 54257 - RNA, 20 nt, Artificial Sequence
  CIITA targeting sequence
gucacccaggcuggagugca

SEQ ID NO: 54258 - RNA, 20 nt, Artificial Sequence
  CIITA targeting sequence
guggcacucugucacccagg

SEQ ID NO: 54259 - RNA, 20 nt, Artificial Sequence
  CIITA targeting sequence
caguggcacucugucaccca

SEQ ID NO: 54260 - RNA, 20 nt, Artificial Sequence
  CIITA targeting sequence
gucucaagagaaaaaagagu

SEQ ID NO: 54261 - RNA, 20 nt, Artificial Sequence
  CIITA targeting sequence
caagagaaaaaagagucagc

SEQ ID NO: 54262 - RNA, 20 nt, Artificial Sequence
  CIITA targeting sequence
agagaaaaaagagucagcac

SEQ ID NO: 54263 - RNA, 20 nt, Artificial Sequence
  CIITA targeting sequence
ugagacggagucucaguggc

SEQ ID NO: 54264 - RNA, 20 nt, Artificial Sequence
  CIITA targeting sequence
cuugagacggagucucagug

SEQ ID NO: 54265 - RNA, 20 nt, Artificial Sequence
  CIITA targeting sequence
uuuuucucuugagacggagu

SEQ ID NO: 54266 - RNA, 20 nt, Artificial Sequence
  CIITA targeting sequence
gcaccugcccuggggucuuc

SEQ ID NO: 54267 - RNA, 20 nt, Artificial Sequence
  CIITA targeting sequence
uccaucagacagcugugcau

SEQ ID NO: 54268 - RNA, 20 nt, Artificial Sequence
  CIITA targeting sequence
aucagacagcugugcauuac

SEQ ID NO: 54269 - RNA, 20 nt, Artificial Sequence
  CIITA targeting sequence
gacagcugugcauuaccuca

SEQ ID NO: 54270 - RNA, 20 nt, Artificial Sequence
  CIITA targeting sequence
gauggaagaccccagggcag

SEQ ID NO: 54271 - RNA, 20 nt, Artificial Sequence
  CIITA targeting sequence
ggugaagguuuucccagagc

SEQ ID NO: 54272 - RNA, 20 nt, Artificial Sequence
  CIITA targeting sequence
ccugagguaaugcacagcug

SEQ ID NO: 54273 - RNA, 20 nt, Artificial Sequence
  CIITA targeting sequence
cagagcacagcugagcuugg

SEQ ID NO: 54274 - RNA, 20 nt, Artificial Sequence
  CIITA targeting sequence
gggaaaaccuucaccugagg

SEQ ID NO: 54275 - RNA, 20 nt, Artificial Sequence
  CIITA targeting sequence
gcugugcucugggaaaaccu

SEQ ID NO: 54276 - RNA, 20 nt, Artificial Sequence
  CIITA targeting sequence
uccugcauguaggacucagu

SEQ ID NO: 54277 - RNA, 20 nt, Artificial Sequence
  CIITA targeting sequence
ugcauguaggacucaguguu

SEQ ID NO: 54278 - RNA, 20 nt, Artificial Sequence
  CIITA targeting sequence
uacaugcaggaugaccaagc

SEQ ID NO: 54279 - RNA, 20 nt, Artificial Sequence
  CIITA targeting sequence
guguugucaaaaguaguuga

SEQ ID NO: 54280 - RNA, 20 nt, Artificial Sequence
  CIITA targeting sequence
aaaguaguugauuaucagcu

SEQ ID NO: 54281 - RNA, 20 nt, Artificial Sequence
  CIITA targeting sequence
acuacuuuugacaacacuga

SEQ ID NO: 54282 - RNA, 20 nt, Artificial Sequence
  CIITA targeting sequence
gcuccaccugggcuguuuuu

SEQ ID NO: 54283 - RNA, 20 nt, Artificial Sequence
  CIITA targeting sequence
accugggcuguuuuuaaccu

SEQ ID NO: 54284 - RNA, 20 nt, Artificial Sequence
  CIITA targeting sequence
cuacccauaucuuuaauuag

SEQ ID NO: 54285 - RNA, 20 nt, Artificial Sequence
  CIITA targeting sequence
uuaauuaggauccacgugcu

SEQ ID NO: 54286 - RNA, 20 nt, Artificial Sequence
  CIITA targeting sequence
uaauuaaagauauggguagg

SEQ ID NO: 54287 - RNA, 20 nt, Artificial Sequence
  CIITA targeting sequence
acgugcugggggcucaggaa

SEQ ID NO: 54288 - RNA, 20 nt, Artificial Sequence
  CIITA targeting sequence
ggaagucuaagcuuuuagaa

SEQ ID NO: 54289 - RNA, 20 nt, Artificial Sequence
  CIITA targeting sequence
ugagcccccagcacguggau

SEQ ID NO: 54290 - RNA, 20 nt, Artificial Sequence
  CIITA targeting sequence
aagcuuuuagaaagcucucc

SEQ ID NO: 54291 - RNA, 20 nt, Artificial Sequence
  CIITA targeting sequence
aaaagcuuagacuuccugag

SEQ ID NO: 54292 - RNA, 20 nt, Artificial Sequence
  CIITA targeting sequence
ccggugggucucgucaucaa

SEQ ID NO: 54293 - RNA, 20 nt, Artificial Sequence
  CIITA targeting sequence
ggugggucucgucaucaacc

SEQ ID NO: 54294 - RNA, 20 nt, Artificial Sequence
  CIITA targeting sequence
cgucaucaaccaggcuuggc

SEQ ID NO: 54295 - RNA, 20 nt, Artificial Sequence
  CIITA targeting sequence
ucaucaaccaggcuuggcag

SEQ ID NO: 54296 - RNA, 20 nt, Artificial Sequence
  CIITA targeting sequence
ucaaccaggcuuggcagcca

SEQ ID NO: 54297 - RNA, 20 nt, Artificial Sequence
  CIITA targeting sequence
accaggcuuggcagccacag

SEQ ID NO: 54298 - RNA, 20 nt, Artificial Sequence
  CIITA targeting sequence
guggcugccaagccugguug

SEQ ID NO: 54299 - RNA, 20 nt, Artificial Sequence
  CIITA targeting sequence
acagcuuccuggcccagaga

SEQ ID NO: 54300 - RNA, 20 nt, Artificial Sequence
  CIITA targeting sequence
uggcccagagauagcugggc

SEQ ID NO: 54301 - RNA, 20 nt, Artificial Sequence
  CIITA targeting sequence
gggccaggaagcuguagauc

SEQ ID NO: 54302 - RNA, 20 nt, Artificial Sequence
  CIITA targeting sequence
cugggccaggaagcuguaga

SEQ ID NO: 54303 - RNA, 20 nt, Artificial Sequence
  CIITA targeting sequence
uguggcccagcuaucucugg

SEQ ID NO: 54304 - RNA, 20 nt, Artificial Sequence
  CIITA targeting sequence
gagcugcccguggcacuggu

SEQ ID NO: 54305 - RNA, 20 nt, Artificial Sequence
  CIITA targeting sequence
gaccccuccuguggcccagc

SEQ ID NO: 54306 - RNA, 20 nt, Artificial Sequence
  CIITA targeting sequence
caaccagugccacgggcagc

SEQ ID NO: 54307 - RNA, 20 nt, Artificial Sequence
  CIITA targeting sequence
ccaguucacaaccagugcca

SEQ ID NO: 54308 - RNA, 20 nt, Artificial Sequence
  CIITA targeting sequence
ucugguggggacccuggagc

SEQ ID NO: 54309 - RNA, 20 nt, Artificial Sequence
  CIITA targeting sequence
gguggggacccuggagcccu

SEQ ID NO: 54310 - RNA, 20 nt, Artificial Sequence
  CIITA targeting sequence
ccaccagaggaagccuucac

SEQ ID NO: 54311 - RNA, 20 nt, Artificial Sequence
  CIITA targeting sequence
aggguccccaccagaggaag

SEQ ID NO: 54312 - RNA, 20 nt, Artificial Sequence
  CIITA targeting sequence
gggcuccaggguccccacca

SEQ ID NO: 54313 - RNA, 20 nt, Artificial Sequence
  CIITA targeting sequence
ugguacucagggcuccaggg

SEQ ID NO: 54314 - RNA, 20 nt, Artificial Sequence
  CIITA targeting sequence
augcaugccccaagcuucug

SEQ ID NO: 54315 - RNA, 20 nt, Artificial Sequence
  CIITA targeting sequence
gaggaggagaagaaaggaag

SEQ ID NO: 54316 - RNA, 20 nt, Artificial Sequence
  CIITA targeting sequence
gaagcuuggggcaugcaugg

SEQ ID NO: 54317 - RNA, 20 nt, Artificial Sequence
  CIITA targeting sequence
ucagaagcuuggggcaugca

SEQ ID NO: 54318 - RNA, 20 nt, Artificial Sequence
  CIITA targeting sequence
uccucagaagcuuggggcau

SEQ ID NO: 54319 - RNA, 20 nt, Artificial Sequence
  CIITA targeting sequence
ccuccucagaagcuuggggc

SEQ ID NO: 54320 - RNA, 20 nt, Artificial Sequence
  CIITA targeting sequence
ucuccuccucagaagcuugg

SEQ ID NO: 54321 - RNA, 20 nt, Artificial Sequence
  CIITA targeting sequence
uuucuucuccuccucagaag

SEQ ID NO: 54322 - RNA, 20 nt, Artificial Sequence
  CIITA targeting sequence
uuccuuucuucuccuccuca

SEQ ID NO: 54323 - RNA, 20 nt, Artificial Sequence
  CIITA targeting sequence
auccuuccuuucuucuccuc

SEQ ID NO: 54324 - RNA, 20 nt, Artificial Sequence
  CIITA targeting sequence
acaugggcuuuuuccauccu

SEQ ID NO: 54325 - RNA, 20 nt, Artificial Sequence
  CIITA targeting sequence
uccacaugggcuuuuuccau

SEQ ID NO: 54326 - RNA, 20 nt, Artificial Sequence
  CIITA targeting sequence
accucuuggacguccagggc

SEQ ID NO: 54327 - RNA, 20 nt, Artificial Sequence
  CIITA targeting sequence
uggacguccagggccaucuu

SEQ ID NO: 54328 - RNA, 20 nt, Artificial Sequence
  CIITA targeting sequence
aagagguggagcagcccugu

SEQ ID NO: 54329 - RNA, 20 nt, Artificial Sequence
  CIITA targeting sequence
agggccaucuugaugcuggg

SEQ ID NO: 54330 - RNA, 20 nt, Artificial Sequence
  CIITA targeting sequence
ugaugcugggccguugcaag

SEQ ID NO: 54331 - RNA, 20 nt, Artificial Sequence
  CIITA targeting sequence
agauggcccuggacguccaa

SEQ ID NO: 54332 - RNA, 20 nt, Artificial Sequence
  CIITA targeting sequence
cuaccuugcaacggcccagc

SEQ ID NO: 54333 - RNA, 20 nt, Artificial Sequence
  CIITA targeting sequence
aguucccuuuuuaaaaagcc

SEQ ID NO: 54334 - RNA, 20 nt, Artificial Sequence
  CIITA targeting sequence
cuuuuuaaaaagcccggugg

SEQ ID NO: 54335 - RNA, 20 nt, Artificial Sequence
  CIITA targeting sequence
agccaccgggcuuuuuaaaa

SEQ ID NO: 54336 - RNA, 20 nt, Artificial Sequence
  CIITA targeting sequence
cgccuguaaucccagcacug

SEQ ID NO: 54337 - RNA, 20 nt, Artificial Sequence
  CIITA targeting sequence
cagcacugugggaggccaaa

SEQ ID NO: 54338 - RNA, 20 nt, Artificial Sequence
  CIITA targeting sequence
cacagugcugggauuacagg

SEQ ID NO: 54339 - RNA, 20 nt, Artificial Sequence
  CIITA targeting sequence
gcccgcuuuggccucccaca

SEQ ID NO: 54340 - RNA, 20 nt, Artificial Sequence
  CIITA targeting sequence
ccugaggucaggaguuccag

SEQ ID NO: 54341 - RNA, 20 nt, Artificial Sequence
  CIITA targeting sequence
ggugaucugcccgcuuuggc

SEQ ID NO: 54342 - RNA, 20 nt, Artificial Sequence
  CIITA targeting sequence
ggaguuccagaccagccugg

SEQ ID NO: 54343 - RNA, 20 nt, Artificial Sequence
  CIITA targeting sequence
ugaccucaggugaucugccc

SEQ ID NO: 54344 - RNA, 20 nt, Artificial Sequence
  CIITA targeting sequence
agaccagccuggccaacaug

SEQ ID NO: 54345 - RNA, 20 nt, Artificial Sequence
  CIITA targeting sequence
ggaacuccugaccucaggug

SEQ ID NO: 54346 - RNA, 20 nt, Artificial Sequence
  CIITA targeting sequence
ccacuaacaauacaaaaaua

SEQ ID NO: 54347 - RNA, 20 nt, Artificial Sequence
  CIITA targeting sequence
acuaacaauacaaaaauaag

SEQ ID NO: 54348 - RNA, 20 nt, Artificial Sequence
  CIITA targeting sequence
cagcuacuugggaggcugag

SEQ ID NO: 54349 - RNA, 20 nt, Artificial Sequence
  CIITA targeting sequence
caaguagcugggacuacagg

SEQ ID NO: 54350 - RNA, 20 nt, Artificial Sequence
  CIITA targeting sequence
gccucccaaguagcugggac

SEQ ID NO: 54351 - RNA, 20 nt, Artificial Sequence
  CIITA targeting sequence
ugccucagccucccaaguag

SEQ ID NO: 54352 - RNA, 20 nt, Artificial Sequence
  CIITA targeting sequence
ccugccucagccucccaagu

SEQ ID NO: 54353 - RNA, 20 nt, Artificial Sequence
  CIITA targeting sequence
cuugaacccaggaggcggag

SEQ ID NO: 54354 - RNA, 20 nt, Artificial Sequence
  CIITA targeting sequence
agcgacucuccugccucagc

SEQ ID NO: 54355 - RNA, 20 nt, Artificial Sequence
  CIITA targeting sequence
uggguucaagcgacucuccu

SEQ ID NO: 54356 - RNA, 20 nt, Artificial Sequence
  CIITA targeting sequence
gccuccuggguucaagcgac

SEQ ID NO: 54357 - RNA, 20 nt, Artificial Sequence
  CIITA targeting sequence
cugcaagcuccgccuccugg

SEQ ID NO: 54358 - RNA, 20 nt, Artificial Sequence
  CIITA targeting sequence
gcucacugcaagcuccgccu

SEQ ID NO: 54359 - RNA, 20 nt, Artificial Sequence
  CIITA targeting sequence
cagcucacugcaagcuccgc

SEQ ID NO: 54360 - RNA, 20 nt, Artificial Sequence
  CIITA targeting sequence
agccugggugacagaacgag

SEQ ID NO: 54361 - RNA, 20 nt, Artificial Sequence
  CIITA targeting sequence
cccaggcuggagugcagugg

SEQ ID NO: 54362 - RNA, 20 nt, Artificial Sequence
  CIITA targeting sequence
gucacccaggcuggagugca

SEQ ID NO: 54363 - RNA, 20 nt, Artificial Sequence
  CIITA targeting sequence
uucugucacccaggcuggag

SEQ ID NO: 54364 - RNA, 20 nt, Artificial Sequence
  CIITA targeting sequence
cguucugucacccaggcugg

SEQ ID NO: 54365 - RNA, 20 nt, Artificial Sequence
  CIITA targeting sequence
aucucggggaaaaaaaaaaa

SEQ ID NO: 54366 - RNA, 20 nt, Artificial Sequence
  CIITA targeting sequence
cggggaaaaaaaaaaaagug

SEQ ID NO: 54367 - RNA, 20 nt, Artificial Sequence
  CIITA targeting sequence
gggaaaaaaaaaaaagugag

SEQ ID NO: 54368 - RNA, 20 nt, Artificial Sequence
  CIITA targeting sequence
ccgagauggagucucguucu

SEQ ID NO: 54369 - RNA, 20 nt, Artificial Sequence
  CIITA targeting sequence
cuuuuuuuuuuuuccccgag

SEQ ID NO: 54370 - RNA, 20 nt, Artificial Sequence
  CIITA targeting sequence
guaaaagggcucacuuuuuu

SEQ ID NO: 54371 - RNA, 20 nt, Artificial Sequence
  CIITA targeting sequence
gguaccacuguacuauuguu

SEQ ID NO: 54372 - RNA, 20 nt, Artificial Sequence
  CIITA targeting sequence
cucagguaccacuguacuau

SEQ ID NO: 54373 - RNA, 20 nt, Artificial Sequence
  CIITA targeting sequence
gucacucagguaccacugua

SEQ ID NO: 54374 - RNA, 20 nt, Artificial Sequence
  CIITA targeting sequence
ugauguucuaaaauagagcu

SEQ ID NO: 54375 - RNA, 20 nt, Artificial Sequence
  CIITA targeting sequence
ggaaaaaguacccaaacauc

SEQ ID NO: 54376 - RNA, 20 nt, Artificial Sequence
  CIITA targeting sequence
aaaauagagcugcacugucc

SEQ ID NO: 54377 - RNA, 20 nt, Artificial Sequence
  CIITA targeting sequence
auuuuagaacaucaggaaaa

SEQ ID NO: 54378 - RNA, 20 nt, Artificial Sequence
  CIITA targeting sequence
aaugugauugucaccagccu

SEQ ID NO: 54379 - RNA, 20 nt, Artificial Sequence
  CIITA targeting sequence
cauuggacagugcagcucua

SEQ ID NO: 54380 - RNA, 20 nt, Artificial Sequence
  CIITA targeting sequence
ccagccucauggagcugugg

SEQ ID NO: 54381 - RNA, 20 nt, Artificial Sequence
  CIITA targeting sequence
uggagcuguggaguacuugg

SEQ ID NO: 54382 - RNA, 20 nt, Artificial Sequence
  CIITA targeting sequence
augaggcuggugacaaucac

SEQ ID NO: 54383 - RNA, 20 nt, Artificial Sequence
  CIITA targeting sequence
acagcuccaugaggcuggug

SEQ ID NO: 54384 - RNA, 20 nt, Artificial Sequence
  CIITA targeting sequence
aaguacuccacagcuccaug

SEQ ID NO: 54385 - RNA, 20 nt, Artificial Sequence
  CIITA targeting sequence
caccagcacacuccaaguac

SEQ ID NO: 54386 - RNA, 20 nt, Artificial Sequence
  CIITA targeting sequence
aucacaccagcacacuccaa

SEQ ID NO: 54387 - RNA, 20 nt, Artificial Sequence
  CIITA targeting sequence
gucuaucacaccagcacacu

SEQ ID NO: 54388 - RNA, 20 nt, Artificial Sequence
  CIITA targeting sequence
cauuccaccagugugggcug

SEQ ID NO: 54389 - RNA, 20 nt, Artificial Sequence
  CIITA targeting sequence
accagugugggcugugcaca

SEQ ID NO: 54390 - RNA, 20 nt, Artificial Sequence
  CIITA targeting sequence
cugugcacagcccacacugg

SEQ ID NO: 54391 - RNA, 20 nt, Artificial Sequence
  CIITA targeting sequence
uuccagaauggaaaggggga

SEQ ID NO: 54392 - RNA, 20 nt, Artificial Sequence
  CIITA targeting sequence
agaauggaaagggggaugaa

SEQ ID NO: 54393 - RNA, 20 nt, Artificial Sequence
  CIITA targeting sequence
ggaaggaagucacugugcac

SEQ ID NO: 54394 - RNA, 20 nt, Artificial Sequence
  CIITA targeting sequence
auucuggaaggaagucacug

SEQ ID NO: 54395 - RNA, 20 nt, Artificial Sequence
  CIITA targeting sequence
cccuuuccauucuggaagga

SEQ ID NO: 54396 - RNA, 20 nt, Artificial Sequence
  CIITA targeting sequence
ucccccuuuccauucuggaa

SEQ ID NO: 54397 - RNA, 20 nt, Artificial Sequence
  CIITA targeting sequence
uucaucccccuuuccauucu

SEQ ID NO: 54398 - RNA, 20 nt, Artificial Sequence
  CIITA targeting sequence
ccaccguaaaguuacucuuu

SEQ ID NO: 54399 - RNA, 20 nt, Artificial Sequence
  CIITA targeting sequence
gguuucaccaccguaaaguu

SEQ ID NO: 54400 - RNA, 20 nt, Artificial Sequence
  CIITA targeting sequence
gccagcuggccaagguuaac

SEQ ID NO: 54401 - RNA, 20 nt, Artificial Sequence
  CIITA targeting sequence
aguaauacaucacguuaaua

SEQ ID NO: 54402 - RNA, 20 nt, Artificial Sequence
  CIITA targeting sequence
cguuaauagcacacaugggu

SEQ ID NO: 54403 - RNA, 20 nt, Artificial Sequence
  CIITA targeting sequence
uacccaugugugcuauuaac

SEQ ID NO: 54404 - RNA, 20 nt, Artificial Sequence
  CIITA targeting sequence
ggcaucuuacccaugugugc

SEQ ID NO: 54405 - RNA, 20 nt, Artificial Sequence
  CIITA targeting sequence
cagggccucaggcaucuuac

SEQ ID NO: 54406 - RNA, 20 nt, Artificial Sequence
  CIITA targeting sequence
uggccucccagggccucagg

SEQ ID NO: 54407 - RNA, 20 nt, Artificial Sequence
  CIITA targeting sequence
aaguccuggccucccagggc

SEQ ID NO: 54408 - RNA, 20 nt, Artificial Sequence
  CIITA targeting sequence
aauuccacagccaguccuca

SEQ ID NO: 54409 - RNA, 20 nt, Artificial Sequence
  CIITA targeting sequence
acagccaguccucaccgccc

SEQ ID NO: 54410 - RNA, 20 nt, Artificial Sequence
  CIITA targeting sequence
ucaccgcccucacguggcuc

SEQ ID NO: 54411 - RNA, 20 nt, Artificial Sequence
  CIITA targeting sequence
ccgcccucacguggcuccug

SEQ ID NO: 54412 - RNA, 20 nt, Artificial Sequence
  CIITA targeting sequence
cguggcuccugcagagagua

SEQ ID NO: 54413 - RNA, 20 nt, Artificial Sequence
  CIITA targeting sequence
ugcagagaguagggacagug

SEQ ID NO: 54414 - RNA, 20 nt, Artificial Sequence
  CIITA targeting sequence
gcaggagccacgugagggcg

SEQ ID NO: 54415 - RNA, 20 nt, Artificial Sequence
  CIITA targeting sequence
cugcaggagccacgugaggg

SEQ ID NO: 54416 - RNA, 20 nt, Artificial Sequence
  CIITA targeting sequence
cuacucucugcaggagccac

SEQ ID NO: 54417 - RNA, 20 nt, Artificial Sequence
  CIITA targeting sequence
ccuuagggcacugucccuac

SEQ ID NO: 54418 - RNA, 20 nt, Artificial Sequence
  CIITA targeting sequence
caaaguccccuuagggcacu

SEQ ID NO: 54419 - RNA, 20 nt, Artificial Sequence
  CIITA targeting sequence
caugugaccacaugaggucu

SEQ ID NO: 54420 - RNA, 20 nt, Artificial Sequence
  CIITA targeting sequence
ugugaccacaugaggucucu

SEQ ID NO: 54421 - RNA, 20 nt, Artificial Sequence
  CIITA targeting sequence
caugagacucccaaaguccc

SEQ ID NO: 54422 - RNA, 20 nt, Artificial Sequence
  CIITA targeting sequence
uguggucacaugagacuccc

SEQ ID NO: 54423 - RNA, 20 nt, Artificial Sequence
  CIITA targeting sequence
cuugaaggccuggagaggca

SEQ ID NO: 54424 - RNA, 20 nt, Artificial Sequence
  CIITA targeting sequence
ugaaggccuggagaggcauu

SEQ ID NO: 54425 - RNA, 20 nt, Artificial Sequence
  CIITA targeting sequence
agagaccucauguggucaca

SEQ ID NO: 54426 - RNA, 20 nt, Artificial Sequence
  CIITA targeting sequence
aggccuucaagagaccucau

SEQ ID NO: 54427 - RNA, 20 nt, Artificial Sequence
  CIITA targeting sequence
ccaggccuucaagagaccuc

SEQ ID NO: 54428 - RNA, 20 nt, Artificial Sequence
  CIITA targeting sequence
gcaaaugccucuccaggccu

SEQ ID NO: 54429 - RNA, 20 nt, Artificial Sequence
  CIITA targeting sequence
uccauagguaugacagccgg

SEQ ID NO: 54430 - RNA, 20 nt, Artificial Sequence
  CIITA targeting sequence
auagguaugacagccggggu

SEQ ID NO: 54431 - RNA, 20 nt, Artificial Sequence
  CIITA targeting sequence
uaccuauggaagacaccaug

SEQ ID NO: 54432 - RNA, 20 nt, Artificial Sequence
  CIITA targeting sequence
agcaccaaccccggcuguca

SEQ ID NO: 54433 - RNA, 20 nt, Artificial Sequence
  CIITA targeting sequence
caagcaccaaccccggcugu

SEQ ID NO: 54434 - RNA, 20 nt, Artificial Sequence
  CIITA targeting sequence
ggucagagccuguaaugcca

SEQ ID NO: 54435 - RNA, 20 nt, Artificial Sequence
  CIITA targeting sequence
gagccuguaaugccacguca

SEQ ID NO: 54436 - RNA, 20 nt, Artificial Sequence
  CIITA targeting sequence
gaccagaggucucaagcacc

SEQ ID NO: 54437 - RNA, 20 nt, Artificial Sequence
  CIITA targeting sequence
ugaauugccacaaacuuagc

SEQ ID NO: 54438 - RNA, 20 nt, Artificial Sequence
  CIITA targeting sequence
ugacguggcauuacaggcuc

SEQ ID NO: 54439 - RNA, 20 nt, Artificial Sequence
  CIITA targeting sequence
cacaguuucugugggucggg

SEQ ID NO: 54440 - RNA, 20 nt, Artificial Sequence
  CIITA targeting sequence
caguuucugugggucggggu

SEQ ID NO: 54441 - RNA, 20 nt, Artificial Sequence
  CIITA targeting sequence
gugggucggggucugguagg

SEQ ID NO: 54442 - RNA, 20 nt, Artificial Sequence
  CIITA targeting sequence
gggucugguaggguguuguu

SEQ ID NO: 54443 - RNA, 20 nt, Artificial Sequence
  CIITA targeting sequence
gguaggguguuguuagguuc

SEQ ID NO: 54444 - RNA, 20 nt, Artificial Sequence
  CIITA targeting sequence
cugcucaggaccucuucagg

SEQ ID NO: 54445 - RNA, 20 nt, Artificial Sequence
  CIITA targeting sequence
gcucaggaccucuucaggcc

SEQ ID NO: 54446 - RNA, 20 nt, Artificial Sequence
  CIITA targeting sequence
ggaccucuucaggccaaaau

SEQ ID NO: 54447 - RNA, 20 nt, Artificial Sequence
  CIITA targeting sequence
ugagcagagaaccuaacaac

SEQ ID NO: 54448 - RNA, 20 nt, Artificial Sequence
  CIITA targeting sequence
ucaggccaaaaucaaggugu

SEQ ID NO: 54449 - RNA, 20 nt, Artificial Sequence
  CIITA targeting sequence
ggccaaaaucaaggugucag

SEQ ID NO: 54450 - RNA, 20 nt, Artificial Sequence
  CIITA targeting sequence
aggugucagccagcugagcu

SEQ ID NO: 54451 - RNA, 20 nt, Artificial Sequence
  CIITA targeting sequence
gccagcugagcucucuucag

SEQ ID NO: 54452 - RNA, 20 nt, Artificial Sequence
  CIITA targeting sequence
gcuggcugacaccuugauuu

SEQ ID NO: 54453 - RNA, 20 nt, Artificial Sequence
  CIITA targeting sequence
cuucaggaggcucugggaag

SEQ ID NO: 54454 - RNA, 20 nt, Artificial Sequence
  CIITA targeting sequence
ucaggaggcucugggaagaa

SEQ ID NO: 54455 - RNA, 20 nt, Artificial Sequence
  CIITA targeting sequence
ggaggcucugggaagaaucc

SEQ ID NO: 54456 - RNA, 20 nt, Artificial Sequence
  CIITA targeting sequence
ugaagagagcucagcuggcu

SEQ ID NO: 54457 - RNA, 20 nt, Artificial Sequence
  CIITA targeting sequence
gggaagaaucccgaaugggc

SEQ ID NO: 54458 - RNA, 20 nt, Artificial Sequence
  CIITA targeting sequence
cagagccuccugaagagagc

SEQ ID NO: 54459 - RNA, 20 nt, Artificial Sequence
  CIITA targeting sequence
ucccagagccuccugaagag

SEQ ID NO: 54460 - RNA, 20 nt, Artificial Sequence
  CIITA targeting sequence
cgaaugggcauccaggcuca

SEQ ID NO: 54461 - RNA, 20 nt, Artificial Sequence
  CIITA targeting sequence
ggauucuucccagagccucc

SEQ ID NO: 54462 - RNA, 20 nt, Artificial Sequence
  CIITA targeting sequence
aggcucaucaggcuguuggc

SEQ ID NO: 54463 - RNA, 20 nt, Artificial Sequence
  CIITA targeting sequence
ucaggcuguuggcagaauuc

SEQ ID NO: 54464 - RNA, 20 nt, Artificial Sequence
  CIITA targeting sequence
ggcuguuggcagaauucagu

SEQ ID NO: 54465 - RNA, 20 nt, Artificial Sequence
  CIITA targeting sequence
gccaacagccugaugagccu

SEQ ID NO: 54466 - RNA, 20 nt, Artificial Sequence
  CIITA targeting sequence
guuccuugcaauuguagggc

SEQ ID NO: 54467 - RNA, 20 nt, Artificial Sequence
  CIITA targeting sequence
uugcaauuguagggcugagg

SEQ ID NO: 54468 - RNA, 20 nt, Artificial Sequence
  CIITA targeting sequence
gcccuacaauugcaaggaac

SEQ ID NO: 54469 - RNA, 20 nt, Artificial Sequence
  CIITA targeting sequence
cauuuccuugccggcuguaa

SEQ ID NO: 54470 - RNA, 20 nt, Artificial Sequence
  CIITA targeting sequence
uugccggcuguaaacuggag

SEQ ID NO: 54471 - RNA, 20 nt, Artificial Sequence
  CIITA targeting sequence
aguuuacagccggcaaggaa

SEQ ID NO: 54472 - RNA, 20 nt, Artificial Sequence
  CIITA targeting sequence
uagagguccccuccaucuuc

SEQ ID NO: 54473 - RNA, 20 nt, Artificial Sequence
  CIITA targeting sequence
aggagccuccaguuuacagc

SEQ ID NO: 54474 - RNA, 20 nt, Artificial Sequence
  CIITA targeting sequence
ccuccaucuucaggaacgag

SEQ ID NO: 54475 - RNA, 20 nt, Artificial Sequence
  CIITA targeting sequence
aucuucaggaacgagccuug

SEQ ID NO: 54476 - RNA, 20 nt, Artificial Sequence
  CIITA targeting sequence
ucaggaacgagccuugaauc

SEQ ID NO: 54477 - RNA, 20 nt, Artificial Sequence
  CIITA targeting sequence
ggaacgagccuugaaucugc

SEQ ID NO: 54478 - RNA, 20 nt, Artificial Sequence
  CIITA targeting sequence
ugaagauggaggggaccucu

SEQ ID NO: 54479 - RNA, 20 nt, Artificial Sequence
  CIITA targeting sequence
uuccugaagauggaggggac

SEQ ID NO: 54480 - RNA, 20 nt, Artificial Sequence
  CIITA targeting sequence
aggcucguuccugaagaugg

SEQ ID NO: 54481 - RNA, 20 nt, Artificial Sequence
  CIITA targeting sequence
gccuccugcucuccagccuc

SEQ ID NO: 54482 - RNA, 20 nt, Artificial Sequence
  CIITA targeting sequence
ugcucuccagccucugauuu

SEQ ID NO: 54483 - RNA, 20 nt, Artificial Sequence
  CIITA targeting sequence
ccagccucugauuuccuggg

SEQ ID NO: 54484 - RNA, 20 nt, Artificial Sequence
  CIITA targeting sequence
agccucugauuuccugggcc

SEQ ID NO: 54485 - RNA, 20 nt, Artificial Sequence
  CIITA targeting sequence
gauuuccugggcccagguuu

SEQ ID NO: 54486 - RNA, 20 nt, Artificial Sequence
  CIITA targeting sequence
gaggcuggagagcaggaggc

SEQ ID NO: 54487 - RNA, 20 nt, Artificial Sequence
  CIITA targeting sequence
ugggcccagguuuagagagg

SEQ ID NO: 54488 - RNA, 20 nt, Artificial Sequence
  CIITA targeting sequence
aaaccugggcccaggaaauc

SEQ ID NO: 54489 - RNA, 20 nt, Artificial Sequence
  CIITA targeting sequence
cuaaaccugggcccaggaaa

SEQ ID NO: 54490 - RNA, 20 nt, Artificial Sequence
  CIITA targeting sequence
ugugauuggcucaggccccc

SEQ ID NO: 54491 - RNA, 20 nt, Artificial Sequence
  CIITA targeting sequence
caugagcccucucuaaaccu

SEQ ID NO: 54492 - RNA, 20 nt, Artificial Sequence
  CIITA targeting sequence
ggcccccuaccuuaagguca

SEQ ID NO: 54493 - RNA, 20 nt, Artificial Sequence
  CIITA targeting sequence
ggugacuugggacuuuaccu

SEQ ID NO: 54494 - RNA, 20 nt, Artificial Sequence
  CIITA targeting sequence
ccugaccuuaagguaggggg

SEQ ID NO: 54495 - RNA, 20 nt, Artificial Sequence
  CIITA targeting sequence
caagucaccugaccuuaagg

SEQ ID NO: 54496 - RNA, 20 nt, Artificial Sequence
  CIITA targeting sequence
ccagaaucacugcacagcaa

SEQ ID NO: 54497 - RNA, 20 nt, Artificial Sequence
  CIITA targeting sequence
agaaucacugcacagcaaca

SEQ ID NO: 54498 - RNA, 20 nt, Artificial Sequence
  CIITA targeting sequence
ggagagguaaagucccaagu

SEQ ID NO: 54499 - RNA, 20 nt, Artificial Sequence
  CIITA targeting sequence
cugcacagcaacaccuagau

SEQ ID NO: 54500 - RNA, 20 nt, Artificial Sequence
  CIITA targeting sequence
agguguugcugugcagugau

SEQ ID NO: 54501 - RNA, 20 nt, Artificial Sequence
  CIITA targeting sequence
uguucgauugaaugacuggg

SEQ ID NO: 54502 - RNA, 20 nt, Artificial Sequence
  CIITA targeting sequence
auugaaugacugggggaagg

SEQ ID NO: 54503 - RNA, 20 nt, Artificial Sequence
  CIITA targeting sequence
aacacgaaucuagguguugc

SEQ ID NO: 54504 - RNA, 20 nt, Artificial Sequence
  CIITA targeting sequence
aucgaacacgaaucuaggug

SEQ ID NO: 54505 - RNA, 20 nt, Artificial Sequence
  CIITA targeting sequence
uucaaucgaacacgaaucua

SEQ ID NO: 54506 - RNA, 20 nt, Artificial Sequence
  CIITA targeting sequence
cccagucauucaaucgaaca

SEQ ID NO: 54507 - RNA, 20 nt, Artificial Sequence
  CIITA targeting sequence
aacggguuggaaucgugucu

SEQ ID NO: 54508 - RNA, 20 nt, Artificial Sequence
  CIITA targeting sequence
aacccguuggauacaccuuc

SEQ ID NO: 54509 - RNA, 20 nt, Artificial Sequence
  CIITA targeting sequence
ugucuguggaggggaagggg

SEQ ID NO: 54510 - RNA, 20 nt, Artificial Sequence
  CIITA targeting sequence
guggaggggaagggguaucu

SEQ ID NO: 54511 - RNA, 20 nt, Artificial Sequence
  CIITA targeting sequence
acagacacgauuccaacccg

SEQ ID NO: 54512 - RNA, 20 nt, Artificial Sequence
  CIITA targeting sequence
ccuccacagacacgauucca

SEQ ID NO: 54513 - RNA, 20 nt, Artificial Sequence
  CIITA targeting sequence
uagaauucuguccacgagga

SEQ ID NO: 54514 - RNA, 20 nt, Artificial Sequence
  CIITA targeting sequence
aagauaccccuuccccucca

SEQ ID NO: 54515 - RNA, 20 nt, Artificial Sequence
  CIITA targeting sequence
guccacgaggaccugccuga

SEQ ID NO: 54516 - RNA, 20 nt, Artificial Sequence
  CIITA targeting sequence
acgaggaccugccugaugga

SEQ ID NO: 54517 - RNA, 20 nt, Artificial Sequence
  CIITA targeting sequence
uggacagaauucuaagauac

SEQ ID NO: 54518 - RNA, 20 nt, Artificial Sequence
  CIITA targeting sequence
ucguggacagaauucuaaga

SEQ ID NO: 54519 - RNA, 20 nt, Artificial Sequence
  CIITA targeting sequence
ggcagguccucguggacaga

SEQ ID NO: 54520 - RNA, 20 nt, Artificial Sequence
  CIITA targeting sequence
aucaggcagguccucgugga

SEQ ID NO: 54521 - RNA, 20 nt, Artificial Sequence
  CIITA targeting sequence
gauccagacagcaugguucc

SEQ ID NO: 54522 - RNA, 20 nt, Artificial Sequence
  CIITA targeting sequence
gaagcccuauugugcuguuc

SEQ ID NO: 54523 - RNA, 20 nt, Artificial Sequence
  CIITA targeting sequence
agacagcaugguuccaaucc

SEQ ID NO: 54524 - RNA, 20 nt, Artificial Sequence
  CIITA targeting sequence
ggaucugaagcccuauugug

SEQ ID NO: 54525 - RNA, 20 nt, Artificial Sequence
  CIITA targeting sequence
aaucccagcuuuacuaccac

SEQ ID NO: 54526 - RNA, 20 nt, Artificial Sequence
  CIITA targeting sequence
cagcuuuacuaccacucaau

SEQ ID NO: 54527 - RNA, 20 nt, Artificial Sequence
  CIITA targeting sequence
auaaaugauuugggacacau

SEQ ID NO: 54528 - RNA, 20 nt, Artificial Sequence
  CIITA targeting sequence
uuuauugagugguaguaaag

SEQ ID NO: 54529 - RNA, 20 nt, Artificial Sequence
  CIITA targeting sequence
caaaucauuuauugaguggu

SEQ ID NO: 54530 - RNA, 20 nt, Artificial Sequence
  CIITA targeting sequence
auuuccucacuuugcaaaau

SEQ ID NO: 54531 - RNA, 20 nt, Artificial Sequence
  CIITA targeting sequence
ucacuuugcaaaauugaagu

SEQ ID NO: 54532 - RNA, 20 nt, Artificial Sequence
  CIITA targeting sequence
cuuugcaaaauugaaguaag

SEQ ID NO: 54533 - RNA, 20 nt, Artificial Sequence
  CIITA targeting sequence
auuuugcaaagugaggaaau

SEQ ID NO: 54534 - RNA, 20 nt, Artificial Sequence
  CIITA targeting sequence
uacuucaauuuugcaaagug

SEQ ID NO: 54535 - RNA, 20 nt, Artificial Sequence
  CIITA targeting sequence
cuacuacucgggagccugag

SEQ ID NO: 54536 - RNA, 20 nt, Artificial Sequence
  CIITA targeting sequence
ggagccugaggcaggggaau

SEQ ID NO: 54537 - RNA, 20 nt, Artificial Sequence
  CIITA targeting sequence
cgaguaguagggacuacaag

SEQ ID NO: 54538 - RNA, 20 nt, Artificial Sequence
  CIITA targeting sequence
ggcucccgaguaguagggac

SEQ ID NO: 54539 - RNA, 20 nt, Artificial Sequence
  CIITA targeting sequence
ccugccucaggcucccgagu

SEQ ID NO: 54540 - RNA, 20 nt, Artificial Sequence
  CIITA targeting sequence
cuugaacccgggaggcggag

SEQ ID NO: 54541 - RNA, 20 nt, Artificial Sequence
  CIITA targeting sequence
agugauuccccugccucagg

SEQ ID NO: 54542 - RNA, 20 nt, Artificial Sequence
  CIITA targeting sequence
cggguucaagugauuccccu

SEQ ID NO: 54543 - RNA, 20 nt, Artificial Sequence
  CIITA targeting sequence
gccucccggguucaagugau

SEQ ID NO: 54544 - RNA, 20 nt, Artificial Sequence
  CIITA targeting sequence
cugcaagcuccgccucccgg

SEQ ID NO: 54545 - RNA, 20 nt, Artificial Sequence
  CIITA targeting sequence
uggcucacugcaagcuccgc

SEQ ID NO: 54546 - RNA, 20 nt, Artificial Sequence
  CIITA targeting sequence
caccauugcacugcagccug

SEQ ID NO: 54547 - RNA, 20 nt, Artificial Sequence
  CIITA targeting sequence
cccaggcugcagugcaaugg

SEQ ID NO: 54548 - RNA, 20 nt, Artificial Sequence
  CIITA targeting sequence
ugcuuugucacccaggcugc

SEQ ID NO: 54549 - RNA, 20 nt, Artificial Sequence
  CIITA targeting sequence
aucauacaaaaaaaaaaaac

SEQ ID NO: 54550 - RNA, 20 nt, Artificial Sequence
  CIITA targeting sequence
uacaaaaaaaaaaaacaaaa

SEQ ID NO: 54551 - RNA, 20 nt, Artificial Sequence
  CIITA targeting sequence
ucccauguguugaugcacug

SEQ ID NO: 54552 - RNA, 20 nt, Artificial Sequence
  CIITA targeting sequence
cauguguugaugcacuggcu

SEQ ID NO: 54553 - RNA, 20 nt, Artificial Sequence
  CIITA targeting sequence
acacaugggaugaauuuaac

SEQ ID NO: 54554 - RNA, 20 nt, Artificial Sequence
  CIITA targeting sequence
ugcuauuauuagugacuugc

SEQ ID NO: 54555 - RNA, 20 nt, Artificial Sequence
  CIITA targeting sequence
cuaauaauagcaggaauauu

SEQ ID NO: 54556 - RNA, 20 nt, Artificial Sequence
  CIITA targeting sequence
cagagcugcccugcccauug

SEQ ID NO: 54557 - RNA, 20 nt, Artificial Sequence
  CIITA targeting sequence
gggagcaagucacuaauaau

SEQ ID NO: 54558 - RNA, 20 nt, Artificial Sequence
  CIITA targeting sequence
caaugggcagggcagcucug

SEQ ID NO: 54559 - RNA, 20 nt, Artificial Sequence
  CIITA targeting sequence
cccaaugggcagggcagcuc

SEQ ID NO: 54560 - RNA, 20 nt, Artificial Sequence
  CIITA targeting sequence
ucugucuuccuagguggaag

SEQ ID NO: 54561 - RNA, 20 nt, Artificial Sequence
  CIITA targeting sequence
gucuuccuagguggaagaau

SEQ ID NO: 54562 - RNA, 20 nt, Artificial Sequence
  CIITA targeting sequence
uccuagguggaagaaucgug

SEQ ID NO: 54563 - RNA, 20 nt, Artificial Sequence
  CIITA targeting sequence
uagguggaagaaucguguuu

SEQ ID NO: 54564 - RNA, 20 nt, Artificial Sequence
  CIITA targeting sequence
accuaggaagacagaagagc

SEQ ID NO: 54565 - RNA, 20 nt, Artificial Sequence
  CIITA targeting sequence
uccaccuaggaagacagaag

SEQ ID NO: 54566 - RNA, 20 nt, Artificial Sequence
  CIITA targeting sequence
uguuuucccugccuuuacca

SEQ ID NO: 54567 - RNA, 20 nt, Artificial Sequence
  CIITA targeting sequence
cugccuuuaccacauucucc

SEQ ID NO: 54568 - RNA, 20 nt, Artificial Sequence
  CIITA targeting sequence
ccgccucucuggcugguguc

SEQ ID NO: 54569 - RNA, 20 nt, Artificial Sequence
  CIITA targeting sequence
gccucucuggcuggugucac

SEQ ID NO: 54570 - RNA, 20 nt, Artificial Sequence
  CIITA targeting sequence
cuggcuggugucacgguccu

SEQ ID NO: 54571 - RNA, 20 nt, Artificial Sequence
  CIITA targeting sequence
ggcuggugucacgguccuuu

SEQ ID NO: 54572 - RNA, 20 nt, Artificial Sequence
  CIITA targeting sequence
cgguccuuuaaggagaauga

SEQ ID NO: 54573 - RNA, 20 nt, Artificial Sequence
  CIITA targeting sequence
uuuaaggagaaugagcgcau

SEQ ID NO: 54574 - RNA, 20 nt, Artificial Sequence
  CIITA targeting sequence
uuaaaggaccgugacaccag

SEQ ID NO: 54575 - RNA, 20 nt, Artificial Sequence
  CIITA targeting sequence
ccuuaaaggaccgugacacc

SEQ ID NO: 54576 - RNA, 20 nt, Artificial Sequence
  CIITA targeting sequence
uucuccuuaaaggaccguga

SEQ ID NO: 54577 - RNA, 20 nt, Artificial Sequence
  CIITA targeting sequence
augcgcucauucuccuuaaa

SEQ ID NO: 54578 - RNA, 20 nt, Artificial Sequence
  CIITA targeting sequence
aggaucuuggucuccccagu

SEQ ID NO: 54579 - RNA, 20 nt, Artificial Sequence
  CIITA targeting sequence
uggagucaaugcgcucauuc

SEQ ID NO: 54580 - RNA, 20 nt, Artificial Sequence
  CIITA targeting sequence
uggucuccccaguuuggcgg

SEQ ID NO: 54581 - RNA, 20 nt, Artificial Sequence
  CIITA targeting sequence
ccccaguuuggcggcuggcc

SEQ ID NO: 54582 - RNA, 20 nt, Artificial Sequence
  CIITA targeting sequence
ccaguuuggcggcuggcccc

SEQ ID NO: 54583 - RNA, 20 nt, Artificial Sequence
  CIITA targeting sequence
gggccagccgccaaacuggg

SEQ ID NO: 54584 - RNA, 20 nt, Artificial Sequence
  CIITA targeting sequence
ugccaagucggggccagccg

SEQ ID NO: 54585 - RNA, 20 nt, Artificial Sequence
  CIITA targeting sequence
caugccaagucggggccagc

SEQ ID NO: 54586 - RNA, 20 nt, Artificial Sequence
  CIITA targeting sequence
gugggaaaaaucuuuuuaaa

SEQ ID NO: 54587 - RNA, 20 nt, Artificial Sequence
  CIITA targeting sequence
cacugacauuuauuucucau

SEQ ID NO: 54588 - RNA, 20 nt, Artificial Sequence
  CIITA targeting sequence
uuuuaaagauguacguaugu

SEQ ID NO: 54589 - RNA, 20 nt, Artificial Sequence
  CIITA targeting sequence
uuaaaaagauuuuucccacu

SEQ ID NO: 54590 - RNA, 20 nt, Artificial Sequence
  CIITA targeting sequence
aaacacaaaugucguugcac

SEQ ID NO: 54591 - RNA, 20 nt, Artificial Sequence
  CIITA targeting sequence
uugcacguguugaugugucu

SEQ ID NO: 54592 - RNA, 20 nt, Artificial Sequence
  CIITA targeting sequence
acacgugcaacgacauuugu

SEQ ID NO: 54593 - RNA, 20 nt, Artificial Sequence
  CIITA targeting sequence
ucagaaaccugggguaggga

SEQ ID NO: 54594 - RNA, 20 nt, Artificial Sequence
  CIITA targeting sequence
gaaaccugggguagggaagu

SEQ ID NO: 54595 - RNA, 20 nt, Artificial Sequence
  CIITA targeting sequence
gaagacacaucaacacgugc

SEQ ID NO: 54596 - RNA, 20 nt, Artificial Sequence
  CIITA targeting sequence
cuaccccagguuucugaaga

SEQ ID NO: 54597 - RNA, 20 nt, Artificial Sequence
  CIITA targeting sequence
accuaccaaacuucccuacc

SEQ ID NO: 54598 - RNA, 20 nt, Artificial Sequence
  CIITA targeting sequence
aucuccuuucucauugcaug

SEQ ID NO: 54599 - RNA, 20 nt, Artificial Sequence
  CIITA targeting sequence
ccuuucucauugcauggcgc

SEQ ID NO: 54600 - RNA, 20 nt, Artificial Sequence
  CIITA targeting sequence
uuucucauugcauggcgcau

SEQ ID NO: 54601 - RNA, 20 nt, Artificial Sequence
  CIITA targeting sequence
cauugcauggcgcauggaag

SEQ ID NO: 54602 - RNA, 20 nt, Artificial Sequence
  CIITA targeting sequence
uugcauggcgcauggaagau

SEQ ID NO: 54603 - RNA, 20 nt, Artificial Sequence
  CIITA targeting sequence
augcgccaugcaaugagaaa

SEQ ID NO: 54604 - RNA, 20 nt, Artificial Sequence
  CIITA targeting sequence
uccaugcgccaugcaaugag

SEQ ID NO: 54605 - RNA, 20 nt, Artificial Sequence
  CIITA targeting sequence
ucuuccaugcgccaugcaau

SEQ ID NO: 54606 - RNA, 20 nt, Artificial Sequence
  CIITA targeting sequence
caucuuccaugcgccaugca

SEQ ID NO: 54607 - RNA, 20 nt, Artificial Sequence
  CIITA targeting sequence
cugugaguguccuguuuauu

SEQ ID NO: 54608 - RNA, 20 nt, Artificial Sequence
  CIITA targeting sequence
cagcgaaacgcuaaagccaa

SEQ ID NO: 54609 - RNA, 20 nt, Artificial Sequence
  CIITA targeting sequence
uguuuauuucauggucaugg

SEQ ID NO: 54610 - RNA, 20 nt, Artificial Sequence
  CIITA targeting sequence
uggucaugggccuuuaguau

SEQ ID NO: 54611 - RNA, 20 nt, Artificial Sequence
  CIITA targeting sequence
ugggccuuuaguaucaaauu

SEQ ID NO: 54612 - RNA, 20 nt, Artificial Sequence
  CIITA targeting sequence
aauuuacuugaaaaccuuau

SEQ ID NO: 54613 - RNA, 20 nt, Artificial Sequence
  CIITA targeting sequence
aguaaauuugauacuaaagg

SEQ ID NO: 54614 - RNA, 20 nt, Artificial Sequence
  CIITA targeting sequence
uaagguuuucaaguaaauuu

SEQ ID NO: 54615 - RNA, 20 nt, Artificial Sequence
  CIITA targeting sequence
guauaauuucauaagguuuu

SEQ ID NO: 54616 - RNA, 20 nt, Artificial Sequence
  CIITA targeting sequence
uucuguauaauuucauaagg

SEQ ID NO: 54617 - RNA, 20 nt, Artificial Sequence
  CIITA targeting sequence
uucuuucuguauaauuucau

SEQ ID NO: 54618 - RNA, 20 nt, Artificial Sequence
  CIITA targeting sequence
uucuuucuuucuguauaauu

SEQ ID NO: 54619 - RNA, 20 nt, Artificial Sequence
  CIITA targeting sequence
ucauucuuucuuucuguaua

SEQ ID NO: 54620 - RNA, 20 nt, Artificial Sequence
  CIITA targeting sequence
uggguaaugggaaagcaacc

SEQ ID NO: 54621 - RNA, 20 nt, Artificial Sequence
  CIITA targeting sequence
cauuacccaagauuccucau

SEQ ID NO: 54622 - RNA, 20 nt, Artificial Sequence
  CIITA targeting sequence
aacaugggugauuuuuaacu

SEQ ID NO: 54623 - RNA, 20 nt, Artificial Sequence
  CIITA targeting sequence
cccauguuggaauuuuugca

SEQ ID NO: 54624 - RNA, 20 nt, Artificial Sequence
  CIITA targeting sequence
aauuaguuaaaaaucaccca

SEQ ID NO: 54625 - RNA, 20 nt, Artificial Sequence
  CIITA targeting sequence
cuucucaguugacuuaaucc

SEQ ID NO: 54626 - RNA, 20 nt, Artificial Sequence
  CIITA targeting sequence
ucucaguugacuuaauccuu

SEQ ID NO: 54627 - RNA, 20 nt, Artificial Sequence
  CIITA targeting sequence
caguugacuuaauccuuuuu

SEQ ID NO: 54628 - RNA, 20 nt, Artificial Sequence
  CIITA targeting sequence
guugacuuaauccuuuuugc

SEQ ID NO: 54629 - RNA, 20 nt, Artificial Sequence
  CIITA targeting sequence
acugagaagagacauguuuu

SEQ ID NO: 54630 - RNA, 20 nt, Artificial Sequence
  CIITA targeting sequence
uuuuugcagugcugggggcc

SEQ ID NO: 54631 - RNA, 20 nt, Artificial Sequence
  CIITA targeting sequence
caggagguuuaaggagcaua

SEQ ID NO: 54632 - RNA, 20 nt, Artificial Sequence
  CIITA targeting sequence
ugggaacgcuuauggccccc

SEQ ID NO: 54633 - RNA, 20 nt, Artificial Sequence
  CIITA targeting sequence
uuaaaccuccugggaacgcu

SEQ ID NO: 54634 - RNA, 20 nt, Artificial Sequence
  CIITA targeting sequence
gcccccaagguggucugcac

SEQ ID NO: 54635 - RNA, 20 nt, Artificial Sequence
  CIITA targeting sequence
gcacagugacaaaaaaggac

SEQ ID NO: 54636 - RNA, 20 nt, Artificial Sequence
  CIITA targeting sequence
cugugcagaccaccuugggg

SEQ ID NO: 54637 - RNA, 20 nt, Artificial Sequence
  CIITA targeting sequence
uuuuuugucacugugcagac

SEQ ID NO: 54638 - RNA, 20 nt, Artificial Sequence
  CIITA targeting sequence
gccugcgucugaggguccug

SEQ ID NO: 54639 - RNA, 20 nt, Artificial Sequence
  CIITA targeting sequence
gaggguccuguagucauggc

SEQ ID NO: 54640 - RNA, 20 nt, Artificial Sequence
  CIITA targeting sequence
gacgcaggcagagcccuuug

SEQ ID NO: 54641 - RNA, 20 nt, Artificial Sequence
  CIITA targeting sequence
uguagucauggccagcugug

SEQ ID NO: 54642 - RNA, 20 nt, Artificial Sequence
  CIITA targeting sequence
uggccagcugugucuagggg

SEQ ID NO: 54643 - RNA, 20 nt, Artificial Sequence
  CIITA targeting sequence
aggggagcaaagacccuguc

SEQ ID NO: 54644 - RNA, 20 nt, Artificial Sequence
  CIITA targeting sequence
ccuagacacagcuggccaug

SEQ ID NO: 54645 - RNA, 20 nt, Artificial Sequence
  CIITA targeting sequence
uugcuccccuagacacagcu

SEQ ID NO: 54646 - RNA, 20 nt, Artificial Sequence
  CIITA targeting sequence
gucaucagccuuccuggcua

SEQ ID NO: 54647 - RNA, 20 nt, Artificial Sequence
  CIITA targeting sequence
ucagccuuccuggcuaaggc

SEQ ID NO: 54648 - RNA, 20 nt, Artificial Sequence
  CIITA targeting sequence
gccuuccuggcuaaggcaag

SEQ ID NO: 54649 - RNA, 20 nt, Artificial Sequence
  CIITA targeting sequence
uggcuaaggcaaggggauga

SEQ ID NO: 54650 - RNA, 20 nt, Artificial Sequence
  CIITA targeting sequence
ccuugccuuagccaggaagg

SEQ ID NO: 54651 - RNA, 20 nt, Artificial Sequence
  CIITA targeting sequence
uccccuugccuuagccagga

SEQ ID NO: 54652 - RNA, 20 nt, Artificial Sequence
  CIITA targeting sequence
aacucauccccuugccuuag

SEQ ID NO: 54653 - RNA, 20 nt, Artificial Sequence
  CIITA targeting sequence
caaacucauccccuugccuu

SEQ ID NO: 54654 - RNA, 20 nt, Artificial Sequence
  CIITA targeting sequence
acuaucucaaacucaucccc

SEQ ID NO: 54655 - RNA, 20 nt, Artificial Sequence
  CIITA targeting sequence
ggcuggaaacuuagccuuca

SEQ ID NO: 54656 - RNA, 20 nt, Artificial Sequence
  CIITA targeting sequence
agccagaacaagugcccaca

SEQ ID NO: 54657 - RNA, 20 nt, Artificial Sequence
  CIITA targeting sequence
aaacaagaucccagaggcag

SEQ ID NO: 54658 - RNA, 20 nt, Artificial Sequence
  CIITA targeting sequence
uguuuugaaggcuaaguuuc

SEQ ID NO: 54659 - RNA, 20 nt, Artificial Sequence
  CIITA targeting sequence
cagaggcagaauuugagacc

SEQ ID NO: 54660 - RNA, 20 nt, Artificial Sequence
  CIITA targeting sequence
gggaucuuguuuugaaggcu

SEQ ID NO: 54661 - RNA, 20 nt, Artificial Sequence
  CIITA targeting sequence
gccucugggaucuuguuuug

SEQ ID NO: 54662 - RNA, 20 nt, Artificial Sequence
  CIITA targeting sequence
aauucugccucugggaucuu

SEQ ID NO: 54663 - RNA, 20 nt, Artificial Sequence
  CIITA targeting sequence
caaauucugccucugggauc

SEQ ID NO: 54664 - RNA, 20 nt, Artificial Sequence
  CIITA targeting sequence
uguuugggucucaaauucug

SEQ ID NO: 54665 - RNA, 20 nt, Artificial Sequence
  CIITA targeting sequence
uuuuccuguuugggucucaa

SEQ ID NO: 54666 - RNA, 20 nt, Artificial Sequence
  CIITA targeting sequence
acauugggcauuuccuuuuc

SEQ ID NO: 54667 - RNA, 20 nt, Artificial Sequence
  CIITA targeting sequence
gagcggagggguccagagcc

SEQ ID NO: 54668 - RNA, 20 nt, Artificial Sequence
  CIITA targeting sequence
gagugcuucaacauugggca

SEQ ID NO: 54669 - RNA, 20 nt, Artificial Sequence
  CIITA targeting sequence
gcucugagugcuucaacauu

SEQ ID NO: 54670 - RNA, 20 nt, Artificial Sequence
  CIITA targeting sequence
agagccguuugauuauaagc

SEQ ID NO: 54671 - RNA, 20 nt, Artificial Sequence
  CIITA targeting sequence
ggaccccuccgcucugagug

SEQ ID NO: 54672 - RNA, 20 nt, Artificial Sequence
  CIITA targeting sequence
aacggcucuggaccccuccg

SEQ ID NO: 54673 - RNA, 20 nt, Artificial Sequence
  CIITA targeting sequence
gcuuauaaucaaacggcucu

SEQ ID NO: 54674 - RNA, 20 nt, Artificial Sequence
  CIITA targeting sequence
uuacacacuuuuacaaaguu

SEQ ID NO: 54675 - RNA, 20 nt, Artificial Sequence
  CIITA targeting sequence
gagacacggaagucgauggu

SEQ ID NO: 54676 - RNA, 20 nt, Artificial Sequence
  CIITA targeting sequence
gaaaacaacuuuguaaaagu

SEQ ID NO: 54677 - RNA, 20 nt, Artificial Sequence
  CIITA targeting sequence
cugaaaacaacuuuguaaaa

SEQ ID NO: 54678 - RNA, 20 nt, Artificial Sequence
  CIITA targeting sequence
gugucucugaaaacaacuuu

SEQ ID NO: 54679 - RNA, 20 nt, Artificial Sequence
  CIITA targeting sequence
augguccgcacuuucucuuc

SEQ ID NO: 54680 - RNA, 20 nt, Artificial Sequence
  CIITA targeting sequence
acuuccgugucucugaaaac

SEQ ID NO: 54681 - RNA, 20 nt, Artificial Sequence
  CIITA targeting sequence
gcacuuucucuuccucauug

SEQ ID NO: 54682 - RNA, 20 nt, Artificial Sequence
  CIITA targeting sequence
cuuccucauuggaguucccu

SEQ ID NO: 54683 - RNA, 20 nt, Artificial Sequence
  CIITA targeting sequence
uccucauuggaguucccugg

SEQ ID NO: 54684 - RNA, 20 nt, Artificial Sequence
  CIITA targeting sequence
ucauuggaguucccuggaaa

SEQ ID NO: 54685 - RNA, 20 nt, Artificial Sequence
  CIITA targeting sequence
uuggaguucccuggaaaagc

SEQ ID NO: 54686 - RNA, 20 nt, Artificial Sequence
  CIITA targeting sequence
aaugaggaagagaaagugcg

SEQ ID NO: 54687 - RNA, 20 nt, Artificial Sequence
  CIITA targeting sequence
cuggaaaagcguguugccag

SEQ ID NO: 54688 - RNA, 20 nt, Artificial Sequence
  CIITA targeting sequence
agggaacuccaaugaggaag

SEQ ID NO: 54689 - RNA, 20 nt, Artificial Sequence
  CIITA targeting sequence
cuggcaacacgcuuuuccag

SEQ ID NO: 54690 - RNA, 20 nt, Artificial Sequence
  CIITA targeting sequence
gucccuggcaacacgcuuuu

SEQ ID NO: 54691 - RNA, 20 nt, Artificial Sequence
  CIITA targeting sequence
ucugucccuggcaacacgcu

SEQ ID NO: 54692 - RNA, 20 nt, Artificial Sequence
  CIITA targeting sequence
gacggggccacagccccacc

SEQ ID NO: 54693 - RNA, 20 nt, Artificial Sequence
  CIITA targeting sequence
gaucaucugucccuggcaac

SEQ ID NO: 54694 - RNA, 20 nt, Artificial Sequence
  CIITA targeting sequence
uuaggagggaaaccugucag

SEQ ID NO: 54695 - RNA, 20 nt, Artificial Sequence
  CIITA targeting sequence
uaaggacacugguggggcug

SEQ ID NO: 54696 - RNA, 20 nt, Artificial Sequence
  CIITA targeting sequence
cuccuaaggacacugguggg

SEQ ID NO: 54697 - RNA, 20 nt, Artificial Sequence
  CIITA targeting sequence
gcagagggaccucagcccug

SEQ ID NO: 54698 - RNA, 20 nt, Artificial Sequence
  CIITA targeting sequence
gcugacagguuucccuccua

SEQ ID NO: 54699 - RNA, 20 nt, Artificial Sequence
  CIITA targeting sequence
cucugcugacagguuucccu

SEQ ID NO: 54700 - RNA, 20 nt, Artificial Sequence
  CIITA targeting sequence
gcccuggcugaucacauggg

SEQ ID NO: 54701 - RNA, 20 nt, Artificial Sequence
  CIITA targeting sequence
gccagggcugaggucccucu

SEQ ID NO: 54702 - RNA, 20 nt, Artificial Sequence
  CIITA targeting sequence
caugggcuaugcuaggccag

SEQ ID NO: 54703 - RNA, 20 nt, Artificial Sequence
  CIITA targeting sequence
gcagaaaccaacagccugcc

SEQ ID NO: 54704 - RNA, 20 nt, Artificial Sequence
  CIITA targeting sequence
gcagauacuggccuagcaua

SEQ ID NO: 54705 - RNA, 20 nt, Artificial Sequence
  CIITA targeting sequence
uaaguuggagagaccugcuc

SEQ ID NO: 54706 - RNA, 20 nt, Artificial Sequence
  CIITA targeting sequence
aacuuaggagcuuuaagggc

SEQ ID NO: 54707 - RNA, 20 nt, Artificial Sequence
  CIITA targeting sequence
ccaacuuaggagcuuuaagg

SEQ ID NO: 54708 - RNA, 20 nt, Artificial Sequence
  CIITA targeting sequence
cuccaacuuaggagcuuuaa

SEQ ID NO: 54709 - RNA, 20 nt, Artificial Sequence
  CIITA targeting sequence
gucacgauccuggcuuugcu

SEQ ID NO: 54710 - RNA, 20 nt, Artificial Sequence
  CIITA targeting sequence
cgauccuggcuuugcuagcc

SEQ ID NO: 54711 - RNA, 20 nt, Artificial Sequence
  CIITA targeting sequence
ugaccgagcaggucucucca

SEQ ID NO: 54712 - RNA, 20 nt, Artificial Sequence
  CIITA targeting sequence
uggcuuugcuagccacacuc

SEQ ID NO: 54713 - RNA, 20 nt, Artificial Sequence
  CIITA targeting sequence
guccccggguucaucucucg

SEQ ID NO: 54714 - RNA, 20 nt, Artificial Sequence
  CIITA targeting sequence
ccggguucaucucucggggc

SEQ ID NO: 54715 - RNA, 20 nt, Artificial Sequence
  CIITA targeting sequence
ucucucggggccaaugcgau

SEQ ID NO: 54716 - RNA, 20 nt, Artificial Sequence
  CIITA targeting sequence
cucggggccaaugcgauguu

SEQ ID NO: 54717 - RNA, 20 nt, Artificial Sequence
  CIITA targeting sequence
cggggccaaugcgauguugu

SEQ ID NO: 54718 - RNA, 20 nt, Artificial Sequence
  CIITA targeting sequence
gggccaaugcgauguuguuu

SEQ ID NO: 54719 - RNA, 20 nt, Artificial Sequence
  CIITA targeting sequence
cauuggccccgagagaugaa

SEQ ID NO: 54720 - RNA, 20 nt, Artificial Sequence
  CIITA targeting sequence
caaacaacaucgcauuggcc

SEQ ID NO: 54721 - RNA, 20 nt, Artificial Sequence
  CIITA targeting sequence
cacaaacaacaucgcauugg

SEQ ID NO: 54722 - RNA, 20 nt, Artificial Sequence
  CIITA targeting sequence
aucucacaaacaacaucgca

SEQ ID NO: 54723 - RNA, 20 nt, Artificial Sequence
  CIITA targeting sequence
ccaucucacaaacaacaucg

SEQ ID NO: 54724 - RNA, 20 nt, Artificial Sequence
  CIITA targeting sequence
cuccaucucacaaacaacau

SEQ ID NO: 54725 - RNA, 20 nt, Artificial Sequence
  CIITA targeting sequence
ggaugaaauucaacacggga

SEQ ID NO: 54726 - RNA, 20 nt, Artificial Sequence
  CIITA targeting sequence
ugaagccacccugguggggg

SEQ ID NO: 54727 - RNA, 20 nt, Artificial Sequence
  CIITA targeting sequence
uccugaagccacccuggugg

SEQ ID NO: 54728 - RNA, 20 nt, Artificial Sequence
  CIITA targeting sequence
acacgggaagcagccucccc

SEQ ID NO: 54729 - RNA, 20 nt, Artificial Sequence
  CIITA targeting sequence
cguguugaauuucauccuga

SEQ ID NO: 54730 - RNA, 20 nt, Artificial Sequence
  CIITA targeting sequence
ccccacccccauggaccgag

SEQ ID NO: 54731 - RNA, 20 nt, Artificial Sequence
  CIITA targeting sequence
auggggguggggggaggcug

SEQ ID NO: 54732 - RNA, 20 nt, Artificial Sequence
  CIITA targeting sequence
guccauggggguggggggag

SEQ ID NO: 54733 - RNA, 20 nt, Artificial Sequence
  CIITA targeting sequence
cgguccaugggggugggggg

SEQ ID NO: 54734 - RNA, 20 nt, Artificial Sequence
  CIITA targeting sequence
ccucucgguccaugggggug

SEQ ID NO: 54735 - RNA, 20 nt, Artificial Sequence
  CIITA targeting sequence
aauaguaucaccucucgguc

SEQ ID NO: 54736 - RNA, 20 nt, Artificial Sequence
  CIITA targeting sequence
ccuuacugucuccacuuccu

SEQ ID NO: 54737 - RNA, 20 nt, Artificial Sequence
  CIITA targeting sequence
ccacuuccuuccugaaaccc

SEQ ID NO: 54738 - RNA, 20 nt, Artificial Sequence
  CIITA targeting sequence
acuuccuuccugaaacccug

SEQ ID NO: 54739 - RNA, 20 nt, Artificial Sequence
  CIITA targeting sequence
uuccugaaacccugaaagag

SEQ ID NO: 54740 - RNA, 20 nt, Artificial Sequence
  CIITA targeting sequence
ugaaacccugaaagaggcuu

SEQ ID NO: 54741 - RNA, 20 nt, Artificial Sequence
  CIITA targeting sequence
ggaaggaaguggagacagua

SEQ ID NO: 54742 - RNA, 20 nt, Artificial Sequence
  CIITA targeting sequence
ggguuucaggaaggaagugg

SEQ ID NO: 54743 - RNA, 20 nt, Artificial Sequence
  CIITA targeting sequence
uucaggguuucaggaaggaa

SEQ ID NO: 54744 - RNA, 20 nt, Artificial Sequence
  CIITA targeting sequence
caggaaaggaagggucuuuc

SEQ ID NO: 54745 - RNA, 20 nt, Artificial Sequence
  CIITA targeting sequence
ugcgaagccucuuucagggu

SEQ ID NO: 54746 - RNA, 20 nt, Artificial Sequence
  CIITA targeting sequence
uuuccugcgaagccucuuuc

SEQ ID NO: 54747 - RNA, 20 nt, Artificial Sequence
  CIITA targeting sequence
uucagaugccugagugcagc

SEQ ID NO: 54748 - RNA, 20 nt, Artificial Sequence
  CIITA targeting sequence
gaugccugagugcagcuggg

SEQ ID NO: 54749 - RNA, 20 nt, Artificial Sequence
  CIITA targeting sequence
gaaagacccuuccuuuccug

SEQ ID NO: 54750 - RNA, 20 nt, Artificial Sequence
  CIITA targeting sequence
ggcaucugaaagacccuucc

SEQ ID NO: 54751 - RNA, 20 nt, Artificial Sequence
  CIITA targeting sequence
cagcugcacucaggcaucug

SEQ ID NO: 54752 - RNA, 20 nt, Artificial Sequence
  CIITA targeting sequence
ccaguuagccaggcugguug

SEQ ID NO: 54753 - RNA, 20 nt, Artificial Sequence
  CIITA targeting sequence
aaccagccuggcuaacuggg

SEQ ID NO: 54754 - RNA, 20 nt, Artificial Sequence
  CIITA targeting sequence
cccuaggcuccaaccagccu

SEQ ID NO: 54755 - RNA, 20 nt, Artificial Sequence
  CIITA targeting sequence
aacccacaacccagccaacu

SEQ ID NO: 54756 - RNA, 20 nt, Artificial Sequence
  CIITA targeting sequence
ggugguucaaacccacaacc

SEQ ID NO: 54757 - RNA, 20 nt, Artificial Sequence
  CIITA targeting sequence
cugaggcacagcuggcccac

SEQ ID NO: 54758 - RNA, 20 nt, Artificial Sequence
  CIITA targeting sequence
gugauucuggugguucaaac

SEQ ID NO: 54759 - RNA, 20 nt, Artificial Sequence
  CIITA targeting sequence
gcagugggccagcugugccu

SEQ ID NO: 54760 - RNA, 20 nt, Artificial Sequence
  CIITA targeting sequence
ugcaaacgccaccauugcuc

SEQ ID NO: 54761 - RNA, 20 nt, Artificial Sequence
  CIITA targeting sequence
ucccugggagaugcuccagc

SEQ ID NO: 54762 - RNA, 20 nt, Artificial Sequence
  CIITA targeting sequence
cugggagaugcuccagcauu

SEQ ID NO: 54763 - RNA, 20 nt, Artificial Sequence
  CIITA targeting sequence
cagggaugagcaaugguggc

SEQ ID NO: 54764 - RNA, 20 nt, Artificial Sequence
  CIITA targeting sequence
cccagggaugagcaauggug

SEQ ID NO: 54765 - RNA, 20 nt, Artificial Sequence
  CIITA targeting sequence
agcauugaccaaaaggguug

SEQ ID NO: 54766 - RNA, 20 nt, Artificial Sequence
  CIITA targeting sequence
augcuggagcaucucccagg

SEQ ID NO: 54767 - RNA, 20 nt, Artificial Sequence
  CIITA targeting sequence
uguccugcucaggacaggcc

SEQ ID NO: 54768 - RNA, 20 nt, Artificial Sequence
  CIITA targeting sequence
ugcucaggacaggccacucu

SEQ ID NO: 54769 - RNA, 20 nt, Artificial Sequence
  CIITA targeting sequence
ggacaggccacucuagagug

SEQ ID NO: 54770 - RNA, 20 nt, Artificial Sequence
  CIITA targeting sequence
ugagcaggacaagacccggc

SEQ ID NO: 54771 - RNA, 20 nt, Artificial Sequence
  CIITA targeting sequence
agagugaucuauagucauac

SEQ ID NO: 54772 - RNA, 20 nt, Artificial Sequence
  CIITA targeting sequence
agaguggccuguccugagca

SEQ ID NO: 54773 - RNA, 20 nt, Artificial Sequence
  CIITA targeting sequence
cucuagaguggccuguccug

SEQ ID NO: 54774 - RNA, 20 nt, Artificial Sequence
  CIITA targeting sequence
auagucauacuguaaggaua

SEQ ID NO: 54775 - RNA, 20 nt, Artificial Sequence
  CIITA targeting sequence
uacuguaaggauagaucugg

SEQ ID NO: 54776 - RNA, 20 nt, Artificial Sequence
  CIITA targeting sequence
uuacaguaugacuauagauc

SEQ ID NO: 54777 - RNA, 20 nt, Artificial Sequence
  CIITA targeting sequence
auccuuacaguaugacuaua

SEQ ID NO: 54778 - RNA, 20 nt, Artificial Sequence
  CIITA targeting sequence
ggguccugugccucccacgg

SEQ ID NO: 54779 - RNA, 20 nt, Artificial Sequence
  CIITA targeting sequence
ugugccucccacggacccug

SEQ ID NO: 54780 - RNA, 20 nt, Artificial Sequence
  CIITA targeting sequence
cacggacccugagcacagaa

SEQ ID NO: 54781 - RNA, 20 nt, Artificial Sequence
  CIITA targeting sequence
gugggaggcacaggacccag

SEQ ID NO: 54782 - RNA, 20 nt, Artificial Sequence
  CIITA targeting sequence
ggguccgugggaggcacagg

SEQ ID NO: 54783 - RNA, 20 nt, Artificial Sequence
  CIITA targeting sequence
gugcucaggguccgugggag

SEQ ID NO: 54784 - RNA, 20 nt, Artificial Sequence
  CIITA targeting sequence
uguguauucugugcucaggg

SEQ ID NO: 54785 - RNA, 20 nt, Artificial Sequence
  CIITA targeting sequence
uguuaguauuaauuaugcac

SEQ ID NO: 54786 - RNA, 20 nt, Artificial Sequence
  CIITA targeting sequence
cauaagugcauaauuaauac

SEQ ID NO: 54787 - RNA, 20 nt, Artificial Sequence
  CIITA targeting sequence
ugaagaaggggacagccaau

SEQ ID NO: 54788 - RNA, 20 nt, Artificial Sequence
  CIITA targeting sequence
agagcaggugcauuucacau

SEQ ID NO: 54789 - RNA, 20 nt, Artificial Sequence
  CIITA targeting sequence
ucaagagcaggugcauuuca

SEQ ID NO: 54790 - RNA, 20 nt, Artificial Sequence
  CIITA targeting sequence
ccuucuucaagagcaggugc

SEQ ID NO: 54791 - RNA, 20 nt, Artificial Sequence
  CIITA targeting sequence
uuggcuguccccuucuucaa

SEQ ID NO: 54792 - RNA, 20 nt, Artificial Sequence
  CIITA targeting sequence
acuguuuuaaucauuggcug

SEQ ID NO: 54793 - RNA, 20 nt, Artificial Sequence
  CIITA targeting sequence
ccaggcuguugcaggcucca

SEQ ID NO: 54794 - RNA, 20 nt, Artificial Sequence
  CIITA targeting sequence
auuaagaaauggcucugaga

SEQ ID NO: 54795 - RNA, 20 nt, Artificial Sequence
  CIITA targeting sequence
uaauggagccugcaacagcc

SEQ ID NO: 54796 - RNA, 20 nt, Artificial Sequence
  CIITA targeting sequence
gagaggguuacuuuagagca

SEQ ID NO: 54797 - RNA, 20 nt, Artificial Sequence
  CIITA targeting sequence
gagccauuucuuaauggagc

SEQ ID NO: 54798 - RNA, 20 nt, Artificial Sequence
  CIITA targeting sequence
cagagccauuucuuaaugga

SEQ ID NO: 54799 - RNA, 20 nt, Artificial Sequence
  CIITA targeting sequence
aaaguaacccucucagagcc

SEQ ID NO: 54800 - RNA, 20 nt, Artificial Sequence
  CIITA targeting sequence
cuugcucuaaaguaacccuc

SEQ ID NO: 54801 - RNA, 20 nt, Artificial Sequence
  CIITA targeting sequence
ucuguugcaggggcucugug

SEQ ID NO: 54802 - RNA, 20 nt, Artificial Sequence
  CIITA targeting sequence
guugcaggggcucugugccu

SEQ ID NO: 54803 - RNA, 20 nt, Artificial Sequence
  CIITA targeting sequence
gugccuggccagcaccaccu

SEQ ID NO: 54804 - RNA, 20 nt, Artificial Sequence
  CIITA targeting sequence
cccgccuuuuuuuuuuuuuu

SEQ ID NO: 54805 - RNA, 20 nt, Artificial Sequence
  CIITA targeting sequence
aaaaaaaaaaaaaaaaaaaa

SEQ ID NO: 54806 - RNA, 20 nt, Artificial Sequence
  CIITA targeting sequence
caaaaaaaaaaaaaaaaaaa

SEQ ID NO: 54807 - RNA, 20 nt, Artificial Sequence
  CIITA targeting sequence
aucucaaaaaaaaaaaaaaa

SEQ ID NO: 54808 - RNA, 20 nt, Artificial Sequence
  CIITA targeting sequence
cguucuguugcccaggcugg

SEQ ID NO: 54809 - RNA, 20 nt, Artificial Sequence
  CIITA targeting sequence
uucuguugcccaggcuggag

SEQ ID NO: 54810 - RNA, 20 nt, Artificial Sequence
  CIITA targeting sequence
guugcccaggcuggagugca

SEQ ID NO: 54811 - RNA, 20 nt, Artificial Sequence
  CIITA targeting sequence
agccugggcaacagaacgag

SEQ ID NO: 54812 - RNA, 20 nt, Artificial Sequence
  CIITA targeting sequence
cggcucacugcaaccucugc

SEQ ID NO: 54813 - RNA, 20 nt, Artificial Sequence
  CIITA targeting sequence
gcucacugcaaccucugccu

SEQ ID NO: 54814 - RNA, 20 nt, Artificial Sequence
  CIITA targeting sequence
cugcaaccucugccucccag

SEQ ID NO: 54815 - RNA, 20 nt, Artificial Sequence
  CIITA targeting sequence
gccucccagguucaagcgau

SEQ ID NO: 54816 - RNA, 20 nt, Artificial Sequence
  CIITA targeting sequence
cagguucaagcgauucuccu

SEQ ID NO: 54817 - RNA, 20 nt, Artificial Sequence
  CIITA targeting sequence
agcgauucuccugccucagc

SEQ ID NO: 54818 - RNA, 20 nt, Artificial Sequence
  CIITA targeting sequence
cuugaaccugggaggcagag

SEQ ID NO: 54819 - RNA, 20 nt, Artificial Sequence
  CIITA targeting sequence
ccugccucagccucccaagu

SEQ ID NO: 54820 - RNA, 20 nt, Artificial Sequence
  CIITA targeting sequence
ugccucagccucccaaguag

SEQ ID NO: 54821 - RNA, 20 nt, Artificial Sequence
  CIITA targeting sequence
gccucccaaguagcugggac

SEQ ID NO: 54822 - RNA, 20 nt, Artificial Sequence
  CIITA targeting sequence
caaguagcugggaccacagg

SEQ ID NO: 54823 - RNA, 20 nt, Artificial Sequence
  CIITA targeting sequence
cagcuacuugggaggcugag

SEQ ID NO: 54824 - RNA, 20 nt, Artificial Sequence
  CIITA targeting sequence
uggcuaacuucuuguauuuu

SEQ ID NO: 54825 - RNA, 20 nt, Artificial Sequence
  CIITA targeting sequence
uguauuuuuaguggagacga

SEQ ID NO: 54826 - RNA, 20 nt, Artificial Sequence
  CIITA targeting sequence
acuaaaaauacaagaaguua

SEQ ID NO: 54827 - RNA, 20 nt, Artificial Sequence
  CIITA targeting sequence
ccacuaaaaauacaagaagu

SEQ ID NO: 54828 - RNA, 20 nt, Artificial Sequence
  CIITA targeting sequence
ucuccacuaaaaauacaaga

SEQ ID NO: 54829 - RNA, 20 nt, Artificial Sequence
  CIITA targeting sequence
cuguguuagccaggaugauc

SEQ ID NO: 54830 - RNA, 20 nt, Artificial Sequence
  CIITA targeting sequence
uggcuaacacagugaaaccu

SEQ ID NO: 54831 - RNA, 20 nt, Artificial Sequence
  CIITA targeting sequence
uccuggcuaacacagugaaa

SEQ ID NO: 54832 - RNA, 20 nt, Artificial Sequence
  CIITA targeting sequence
caaucucuugaccucgugau

SEQ ID NO: 54833 - RNA, 20 nt, Artificial Sequence
  CIITA targeting sequence
aucucuugaccucgugaucc

SEQ ID NO: 54834 - RNA, 20 nt, Artificial Sequence
  CIITA targeting sequence
cuugaccucgugauccaccc

SEQ ID NO: 54835 - RNA, 20 nt, Artificial Sequence
  CIITA targeting sequence
ugaccucgugauccacccac

SEQ ID NO: 54836 - RNA, 20 nt, Artificial Sequence
  CIITA targeting sequence
agagauugagaucauccugg

SEQ ID NO: 54837 - RNA, 20 nt, Artificial Sequence
  CIITA targeting sequence
ugauccacccaccuuggccu

SEQ ID NO: 54838 - RNA, 20 nt, Artificial Sequence
  CIITA targeting sequence
cgaggucaagagauugagau

SEQ ID NO: 54839 - RNA, 20 nt, Artificial Sequence
  CIITA targeting sequence
acccaccuuggccucccaaa

SEQ ID NO: 54840 - RNA, 20 nt, Artificial Sequence
  CIITA targeting sequence
caaaaugcugggauuacagg

SEQ ID NO: 54841 - RNA, 20 nt, Artificial Sequence
  CIITA targeting sequence
cagcauuuugggaggccaag

SEQ ID NO: 54842 - RNA, 20 nt, Artificial Sequence
  CIITA targeting sequence
cgccuguaaucccagcauuu

SEQ ID NO: 54843 - RNA, 20 nt, Artificial Sequence
  CIITA targeting sequence
cuuauuuuauggaaacccca

SEQ ID NO: 54844 - RNA, 20 nt, Artificial Sequence
  CIITA targeting sequence
auaaaauaagggacuggcug

SEQ ID NO: 54845 - RNA, 20 nt, Artificial Sequence
  CIITA targeting sequence
agccacccaagaaccuucgu

SEQ ID NO: 54846 - RNA, 20 nt, Artificial Sequence
  CIITA targeting sequence
uggguggcuggaauaggcug

SEQ ID NO: 54847 - RNA, 20 nt, Artificial Sequence
  CIITA targeting sequence
uuaaguggcucugaaguggg

SEQ ID NO: 54848 - RNA, 20 nt, Artificial Sequence
  CIITA targeting sequence
gaagugggaauggcuacuua

SEQ ID NO: 54849 - RNA, 20 nt, Artificial Sequence
  CIITA targeting sequence
gagccacuuaacgaagguuc

SEQ ID NO: 54850 - RNA, 20 nt, Artificial Sequence
  CIITA targeting sequence
cacuucagagccacuuaacg

SEQ ID NO: 54851 - RNA, 20 nt, Artificial Sequence
  CIITA targeting sequence
cugcaaauuaaguagccauu

SEQ ID NO: 54852 - RNA, 20 nt, Artificial Sequence
  CIITA targeting sequence
gcacaaaaugaaaaucaaua

SEQ ID NO: 54853 - RNA, 20 nt, Artificial Sequence
  CIITA targeting sequence
uuuugugcugaucccugcaa

SEQ ID NO: 54854 - RNA, 20 nt, Artificial Sequence
  CIITA targeting sequence
auaauuuucagaaauuaaga

SEQ ID NO: 54855 - RNA, 20 nt, Artificial Sequence
  CIITA targeting sequence
gaaauuaagauucaagaugg

SEQ ID NO: 54856 - RNA, 20 nt, Artificial Sequence
  CIITA targeting sequence
gaaaauuauugauuuucauu

SEQ ID NO: 54857 - RNA, 20 nt, Artificial Sequence
  CIITA targeting sequence
uaauuucugaaaauuauuga

SEQ ID NO: 54858 - RNA, 20 nt, Artificial Sequence
  CIITA targeting sequence
agaugguaauagagcauucg

SEQ ID NO: 54859 - RNA, 20 nt, Artificial Sequence
  CIITA targeting sequence
ugaaucuuaauuucugaaaa

SEQ ID NO: 54860 - RNA, 20 nt, Artificial Sequence
  CIITA targeting sequence
auuaccaucuugaaucuuaa

SEQ ID NO: 54861 - RNA, 20 nt, Artificial Sequence
  CIITA targeting sequence
agugagcauuggggacccuu

SEQ ID NO: 54862 - RNA, 20 nt, Artificial Sequence
  CIITA targeting sequence
aaugcucuauuaccaucuug

SEQ ID NO: 54863 - RNA, 20 nt, Artificial Sequence
  CIITA targeting sequence
cucgaaugcucuauuaccau

SEQ ID NO: 54864 - RNA, 20 nt, Artificial Sequence
  CIITA targeting sequence
ccaaugcucacucgaaugcu

SEQ ID NO: 54865 - RNA, 20 nt, Artificial Sequence
  CIITA targeting sequence
gagcacagggcccugucugu

SEQ ID NO: 54866 - RNA, 20 nt, Artificial Sequence
  CIITA targeting sequence
gaaggguccccaaugcucac

SEQ ID NO: 54867 - RNA, 20 nt, Artificial Sequence
  CIITA targeting sequence
gugcaguuugcacacagccc

SEQ ID NO: 54868 - RNA, 20 nt, Artificial Sequence
  CIITA targeting sequence
ggggagaguacaaggcaggc

SEQ ID NO: 54869 - RNA, 20 nt, Artificial Sequence
  CIITA targeting sequence
ccagaccugggcugugugca

SEQ ID NO: 54870 - RNA, 20 nt, Artificial Sequence
  CIITA targeting sequence
ccccagaccugggcugugug

SEQ ID NO: 54871 - RNA, 20 nt, Artificial Sequence
  CIITA targeting sequence
caugcuacaagccagcugcc

SEQ ID NO: 54872 - RNA, 20 nt, Artificial Sequence
  CIITA targeting sequence
uucacaugcuacaagccagc

SEQ ID NO: 54873 - RNA, 20 nt, Artificial Sequence
  CIITA targeting sequence
guucauucacaugcuacaag

SEQ ID NO: 54874 - RNA, 20 nt, Artificial Sequence
  CIITA targeting sequence
cccugcccuuugugggaguu

SEQ ID NO: 54875 - RNA, 20 nt, Artificial Sequence
  CIITA targeting sequence
cacaaagggcagggugacuc

SEQ ID NO: 54876 - RNA, 20 nt, Artificial Sequence
  CIITA targeting sequence
acucccacaaagggcagggu

SEQ ID NO: 54877 - RNA, 20 nt, Artificial Sequence
  CIITA targeting sequence
uuucuaggcuguuggccagg

SEQ ID NO: 54878 - RNA, 20 nt, Artificial Sequence
  CIITA targeting sequence
aggcuguuggccagggcagg

SEQ ID NO: 54879 - RNA, 20 nt, Artificial Sequence
  CIITA targeting sequence
gcccugcccuggccaacagc

SEQ ID NO: 54880 - RNA, 20 nt, Artificial Sequence
  CIITA targeting sequence
ucagcccugcccuggccaac

SEQ ID NO: 54881 - RNA, 20 nt, Artificial Sequence
  CIITA targeting sequence
ugucaucagcccugcccugg

SEQ ID NO: 54882 - RNA, 20 nt, Artificial Sequence
  CIITA targeting sequence
gcccacaccagggcaagccc

SEQ ID NO: 54883 - RNA, 20 nt, Artificial Sequence
  CIITA targeting sequence
uauucagcccacaccagggc

SEQ ID NO: 54884 - RNA, 20 nt, Artificial Sequence
  CIITA targeting sequence
caguguaucauauucagccc

SEQ ID NO: 54885 - RNA, 20 nt, Artificial Sequence
  CIITA targeting sequence
cacaguguaucauauucagc

SEQ ID NO: 54886 - RNA, 20 nt, Artificial Sequence
  CIITA targeting sequence
acuucucacaguguaucaua

SEQ ID NO: 54887 - RNA, 20 nt, Artificial Sequence
  CIITA targeting sequence
cuucaacuucucacagugua

SEQ ID NO: 54888 - RNA, 20 nt, Artificial Sequence
  CIITA targeting sequence
cccucccuucaacuucucac

SEQ ID NO: 54889 - RNA, 20 nt, Artificial Sequence
  CIITA targeting sequence
aaucccccucccuucaacuu

SEQ ID NO: 54890 - RNA, 20 nt, Artificial Sequence
  CIITA targeting sequence
aggcagcaucaucucuguac

SEQ ID NO: 54891 - RNA, 20 nt, Artificial Sequence
  CIITA targeting sequence
ucucuguacaacaggaaguc

SEQ ID NO: 54892 - RNA, 20 nt, Artificial Sequence
  CIITA targeting sequence
cuguacaacaggaagucccu

SEQ ID NO: 54893 - RNA, 20 nt, Artificial Sequence
  CIITA targeting sequence
guacaacaggaagucccuga

SEQ ID NO: 54894 - RNA, 20 nt, Artificial Sequence
  CIITA targeting sequence
uguuguacagagaugaugcu

SEQ ID NO: 54895 - RNA, 20 nt, Artificial Sequence
  CIITA targeting sequence
cugagcuuggacacaugacu

SEQ ID NO: 54896 - RNA, 20 nt, Artificial Sequence
  CIITA targeting sequence
gggacuuccuguuguacaga

SEQ ID NO: 54897 - RNA, 20 nt, Artificial Sequence
  CIITA targeting sequence
aagcucagggacuuccuguu

SEQ ID NO: 54898 - RNA, 20 nt, Artificial Sequence
  CIITA targeting sequence
uguguccaagcucagggacu

SEQ ID NO: 54899 - RNA, 20 nt, Artificial Sequence
  CIITA targeting sequence
agucauguguccaagcucag

SEQ ID NO: 54900 - RNA, 20 nt, Artificial Sequence
  CIITA targeting sequence
ccugucacaagguucaaggu

SEQ ID NO: 54901 - RNA, 20 nt, Artificial Sequence
  CIITA targeting sequence
caagguucaaggugaaaccc

SEQ ID NO: 54902 - RNA, 20 nt, Artificial Sequence
  CIITA targeting sequence
aggugaaacccagaaggcca

SEQ ID NO: 54903 - RNA, 20 nt, Artificial Sequence
  CIITA targeting sequence
ccuugaaccuugugacaggu

SEQ ID NO: 54904 - RNA, 20 nt, Artificial Sequence
  CIITA targeting sequence
ggguuucaccuugaaccuug

SEQ ID NO: 54905 - RNA, 20 nt, Artificial Sequence
  CIITA targeting sequence
uugccuggccuucuggguuu

SEQ ID NO: 54906 - RNA, 20 nt, Artificial Sequence
  CIITA targeting sequence
augcaucauugccuggccuu

SEQ ID NO: 54907 - RNA, 20 nt, Artificial Sequence
  CIITA targeting sequence
cuacccaagucagcauuuuc

SEQ ID NO: 54908 - RNA, 20 nt, Artificial Sequence
  CIITA targeting sequence
gcauuuucuaauaccauuaa

SEQ ID NO: 54909 - RNA, 20 nt, Artificial Sequence
  CIITA targeting sequence
aauaccauuaaacacuuuug

SEQ ID NO: 54910 - RNA, 20 nt, Artificial Sequence
  CIITA targeting sequence
cgccuguaaucccagcacuu

SEQ ID NO: 54911 - RNA, 20 nt, Artificial Sequence
  CIITA targeting sequence
cagcacuuugggaggcugag

SEQ ID NO: 54912 - RNA, 20 nt, Artificial Sequence
  CIITA targeting sequence
caaagugcugggauuacagg

SEQ ID NO: 54913 - RNA, 20 nt, Artificial Sequence
  CIITA targeting sequence
gccucccaaagugcugggau

SEQ ID NO: 54914 - RNA, 20 nt, Artificial Sequence
  CIITA targeting sequence
gcccgccucagccucccaaa

SEQ ID NO: 54915 - RNA, 20 nt, Artificial Sequence
  CIITA targeting sequence
uaaucugcccgccucagccu

SEQ ID NO: 54916 - RNA, 20 nt, Artificial Sequence
  CIITA targeting sequence
ggagaccgagaccauccugg

SEQ ID NO: 54917 - RNA, 20 nt, Artificial Sequence
  CIITA targeting sequence
ugaccucauaaucugcccgc

SEQ ID NO: 54918 - RNA, 20 nt, Artificial Sequence
  CIITA targeting sequence
ccugaccucauaaucugccc

SEQ ID NO: 54919 - RNA, 20 nt, Artificial Sequence
  CIITA targeting sequence
gucuccugaccucauaaucu

SEQ ID NO: 54920 - RNA, 20 nt, Artificial Sequence
  CIITA targeting sequence
cggucuccugaccucauaau

SEQ ID NO: 54921 - RNA, 20 nt, Artificial Sequence
  CIITA targeting sequence
ugguuaacacggugaauacu

SEQ ID NO: 54922 - RNA, 20 nt, Artificial Sequence
  CIITA targeting sequence
ccguguuaaccaggaugguc

SEQ ID NO: 54923 - RNA, 20 nt, Artificial Sequence
  CIITA targeting sequence
cagcuauucgggaggcugag

SEQ ID NO: 54924 - RNA, 20 nt, Artificial Sequence
  CIITA targeting sequence
ggaggcugaggcaggaaaau

SEQ ID NO: 54925 - RNA, 20 nt, Artificial Sequence
  CIITA targeting sequence
cgaauagcugggacuacagg

SEQ ID NO: 54926 - RNA, 20 nt, Artificial Sequence
  CIITA targeting sequence
gccucccgaauagcugggac

SEQ ID NO: 54927 - RNA, 20 nt, Artificial Sequence
  CIITA targeting sequence
ugccucagccucccgaauag

SEQ ID NO: 54928 - RNA, 20 nt, Artificial Sequence
  CIITA targeting sequence
ugccauuuuccugccucagc

SEQ ID NO: 54929 - RNA, 20 nt, Artificial Sequence
  CIITA targeting sequence
uggguucaugccauuuuccu

SEQ ID NO: 54930 - RNA, 20 nt, Artificial Sequence
  CIITA targeting sequence
gccuccuggguucaugccau

SEQ ID NO: 54931 - RNA, 20 nt, Artificial Sequence
  CIITA targeting sequence
cugcaagcuccgccuccugg

SEQ ID NO: 54932 - RNA, 20 nt, Artificial Sequence
  CIITA targeting sequence
gcucacugcaagcuccgccu

SEQ ID NO: 54933 - RNA, 20 nt, Artificial Sequence
  CIITA targeting sequence
cggcucacugcaagcuccgc

SEQ ID NO: 54934 - RNA, 20 nt, Artificial Sequence
  CIITA targeting sequence
agccugggcaacagagcgag

SEQ ID NO: 54935 - RNA, 20 nt, Artificial Sequence
  CIITA targeting sequence
guugcccaggcuggagugca

SEQ ID NO: 54936 - RNA, 20 nt, Artificial Sequence
  CIITA targeting sequence
cucuguugcccaggcuggag

SEQ ID NO: 54937 - RNA, 20 nt, Artificial Sequence
  CIITA targeting sequence
cgcucuguugcccaggcugg

SEQ ID NO: 54938 - RNA, 20 nt, Artificial Sequence
  CIITA targeting sequence
aucucaauaaaaaaaaaacc

SEQ ID NO: 54939 - RNA, 20 nt, Artificial Sequence
  CIITA targeting sequence
caauaaaaaaaaaaccuuuu

SEQ ID NO: 54940 - RNA, 20 nt, Artificial Sequence
  CIITA targeting sequence
auaaaaaaaaaaccuuuuuu

SEQ ID NO: 54941 - RNA, 20 nt, Artificial Sequence
  CIITA targeting sequence
auaaaaaaagguuuuuuuuu

SEQ ID NO: 54942 - RNA, 20 nt, Artificial Sequence
  CIITA targeting sequence
uaucuauaaaaaaagguuuu

SEQ ID NO: 54943 - RNA, 20 nt, Artificial Sequence
  CIITA targeting sequence
cgguguguugaccaggcugg

SEQ ID NO: 54944 - RNA, 20 nt, Artificial Sequence
  CIITA targeting sequence
guguguugaccaggcugguc

SEQ ID NO: 54945 - RNA, 20 nt, Artificial Sequence
  CIITA targeting sequence
acacaccgagaccucguauc

SEQ ID NO: 54946 - RNA, 20 nt, Artificial Sequence
  CIITA targeting sequence
ugaauucuuggucucaagug

SEQ ID NO: 54947 - RNA, 20 nt, Artificial Sequence
  CIITA targeting sequence
agaccagccuggucaacaca

SEQ ID NO: 54948 - RNA, 20 nt, Artificial Sequence
  CIITA targeting sequence
uggucucaagugauccuccu

SEQ ID NO: 54949 - RNA, 20 nt, Artificial Sequence
  CIITA targeting sequence
caagugauccuccugucucg

SEQ ID NO: 54950 - RNA, 20 nt, Artificial Sequence
  CIITA targeting sequence
agugauccuccugucucggc

SEQ ID NO: 54951 - RNA, 20 nt, Artificial Sequence
  CIITA targeting sequence
cuugagaccaagaauucaag

SEQ ID NO: 54952 - RNA, 20 nt, Artificial Sequence
  CIITA targeting sequence
uccugucucggcgucccaag

SEQ ID NO: 54953 - RNA, 20 nt, Artificial Sequence
  CIITA targeting sequence
ugucucggcgucccaaggug

SEQ ID NO: 54954 - RNA, 20 nt, Artificial Sequence
  CIITA targeting sequence
cggcgucccaagguguuggg

SEQ ID NO: 54955 - RNA, 20 nt, Artificial Sequence
  CIITA targeting sequence
gcgucccaagguguugggau

SEQ ID NO: 54956 - RNA, 20 nt, Artificial Sequence
  CIITA targeting sequence
caagguguugggauuacagu

SEQ ID NO: 54957 - RNA, 20 nt, Artificial Sequence
  CIITA targeting sequence
caacaccuugggacgccgag

SEQ ID NO: 54958 - RNA, 20 nt, Artificial Sequence
  CIITA targeting sequence
ugagccacugcaccuggccu

SEQ ID NO: 54959 - RNA, 20 nt, Artificial Sequence
  CIITA targeting sequence
ugacuguaaucccaacaccu

SEQ ID NO: 54960 - RNA, 20 nt, Artificial Sequence
  CIITA targeting sequence
aacaccauuuugaaaauuuu

SEQ ID NO: 54961 - RNA, 20 nt, Artificial Sequence
  CIITA targeting sequence
aaaugguguuggaggccagg

SEQ ID NO: 54962 - RNA, 20 nt, Artificial Sequence
  CIITA targeting sequence
aaauuuucaaaaugguguug

SEQ ID NO: 54963 - RNA, 20 nt, Artificial Sequence
  CIITA targeting sequence
gugauuuuggauuacaucug

SEQ ID NO: 54964 - RNA, 20 nt, Artificial Sequence
  CIITA targeting sequence
cagauauaucaaaauuuuca

SEQ ID NO: 54965 - RNA, 20 nt, Artificial Sequence
  CIITA targeting sequence
aaaaucacagauauaucaaa

SEQ ID NO: 54966 - RNA, 20 nt, Artificial Sequence
  CIITA targeting sequence
guuuuguuacuucuguuaga

SEQ ID NO: 54967 - RNA, 20 nt, Artificial Sequence
  CIITA targeting sequence
guuagagaaaacugaccugg

SEQ ID NO: 54968 - RNA, 20 nt, Artificial Sequence
  CIITA targeting sequence
aacagaaguaacaaaacaga

SEQ ID NO: 54969 - RNA, 20 nt, Artificial Sequence
  CIITA targeting sequence
cuaacagaaguaacaaaaca

SEQ ID NO: 54970 - RNA, 20 nt, Artificial Sequence
  CIITA targeting sequence
guuuucucuaacagaaguaa

SEQ ID NO: 54971 - RNA, 20 nt, Artificial Sequence
  CIITA targeting sequence
ugccuauaaucccagcacuu

SEQ ID NO: 54972 - RNA, 20 nt, Artificial Sequence
  CIITA targeting sequence
cagcacuuugggaggacaag

SEQ ID NO: 54973 - RNA, 20 nt, Artificial Sequence
  CIITA targeting sequence
caaagugcugggauuauagg

SEQ ID NO: 54974 - RNA, 20 nt, Artificial Sequence
  CIITA targeting sequence
ucccaaagugcugggauuau

SEQ ID NO: 54975 - RNA, 20 nt, Artificial Sequence
  CIITA targeting sequence
acccgccuuguccucccaaa

SEQ ID NO: 54976 - RNA, 20 nt, Artificial Sequence
  CIITA targeting sequence
cuugagaaucaggaguuuua

SEQ ID NO: 54977 - RNA, 20 nt, Artificial Sequence
  CIITA targeting sequence
agugauccacccgccuuguc

SEQ ID NO: 54978 - RNA, 20 nt, Artificial Sequence
  CIITA targeting sequence
caagugauccacccgccuug

SEQ ID NO: 54979 - RNA, 20 nt, Artificial Sequence
  CIITA targeting sequence
ggaguuuuagaccauccugg

SEQ ID NO: 54980 - RNA, 20 nt, Artificial Sequence
  CIITA targeting sequence
ugauucucaagugauccacc

SEQ ID NO: 54981 - RNA, 20 nt, Artificial Sequence
  CIITA targeting sequence
aaaacuccugauucucaagu

SEQ ID NO: 54982 - RNA, 20 nt, Artificial Sequence
  CIITA targeting sequence
uggccaacauggugaaaccc

SEQ ID NO: 54983 - RNA, 20 nt, Artificial Sequence
  CIITA targeting sequence
ccauguuggccaggaugguc

SEQ ID NO: 54984 - RNA, 20 nt, Artificial Sequence
  CIITA targeting sequence
auacuaaaaaucaaaaauua

SEQ ID NO: 54985 - RNA, 20 nt, Artificial Sequence
  CIITA targeting sequence
aaaauuagccaggcauggug

SEQ ID NO: 54986 - RNA, 20 nt, Artificial Sequence
  CIITA targeting sequence
cagcuacucagaggcugagg

SEQ ID NO: 54987 - RNA, 20 nt, Artificial Sequence
  CIITA targeting sequence
gaggcugaggcaggagaauc

SEQ ID NO: 54988 - RNA, 20 nt, Artificial Sequence
  CIITA targeting sequence
gaguagcugggauuacaggc

SEQ ID NO: 54989 - RNA, 20 nt, Artificial Sequence
  CIITA targeting sequence
gccucugaguagcugggauu

SEQ ID NO: 54990 - RNA, 20 nt, Artificial Sequence
  CIITA targeting sequence
ugccucagccucugaguagc

SEQ ID NO: 54991 - RNA, 20 nt, Artificial Sequence
  CIITA targeting sequence
ccugccucagccucugagua

SEQ ID NO: 54992 - RNA, 20 nt, Artificial Sequence
  CIITA targeting sequence
cuugaacccacgagacagag

SEQ ID NO: 54993 - RNA, 20 nt, Artificial Sequence
  CIITA targeting sequence
agcgauucuccugccucagc

SEQ ID NO: 54994 - RNA, 20 nt, Artificial Sequence
  CIITA targeting sequence
uggguucaagcgauucuccu

SEQ ID NO: 54995 - RNA, 20 nt, Artificial Sequence
  CIITA targeting sequence
cguggguucaagcgauucuc

SEQ ID NO: 54996 - RNA, 20 nt, Artificial Sequence
  CIITA targeting sequence
gucucguggguucaagcgau

SEQ ID NO: 54997 - RNA, 20 nt, Artificial Sequence
  CIITA targeting sequence
cugucucguggguucaagcg

SEQ ID NO: 54998 - RNA, 20 nt, Artificial Sequence
  CIITA targeting sequence
cugcaaucucugucucgugg

SEQ ID NO: 54999 - RNA, 20 nt, Artificial Sequence
  CIITA targeting sequence
gcucacugcaaucucugucu

SEQ ID NO: 55000 - RNA, 20 nt, Artificial Sequence
  CIITA targeting sequence
cggcucacugcaaucucugu

SEQ ID NO: 55001 - RNA, 20 nt, Artificial Sequence
  CIITA targeting sequence
cgccacugcacuccagccuc

SEQ ID NO: 55002 - RNA, 20 nt, Artificial Sequence
  CIITA targeting sequence
agccucagcgacagaacaag

SEQ ID NO: 55003 - RNA, 20 nt, Artificial Sequence
  CIITA targeting sequence
gcgacagaacaagacucugc

SEQ ID NO: 55004 - RNA, 20 nt, Artificial Sequence
  CIITA targeting sequence
cugaggcuggagugcagugg

SEQ ID NO: 55005 - RNA, 20 nt, Artificial Sequence
  CIITA targeting sequence
gucgcugaggcuggagugca

SEQ ID NO: 55006 - RNA, 20 nt, Artificial Sequence
  CIITA targeting sequence
uguucugucgcugaggcugg

SEQ ID NO: 55007 - RNA, 20 nt, Artificial Sequence
  CIITA targeting sequence
gccuccagaaaaaaaaacaa

SEQ ID NO: 55008 - RNA, 20 nt, Artificial Sequence
  CIITA targeting sequence
agaaaaaaaaacaaaacuuc

SEQ ID NO: 55009 - RNA, 20 nt, Artificial Sequence
  CIITA targeting sequence
ggaggcagagucuuguucug

SEQ ID NO: 55010 - RNA, 20 nt, Artificial Sequence
  CIITA targeting sequence
aaagcagauuugucauugcc

SEQ ID NO: 55011 - RNA, 20 nt, Artificial Sequence
  CIITA targeting sequence
gcuuuugaaguuuuguuuuu

SEQ ID NO: 55012 - RNA, 20 nt, Artificial Sequence
  CIITA targeting sequence
uugccaggugaccuugucaa

SEQ ID NO: 55013 - RNA, 20 nt, Artificial Sequence
  CIITA targeting sequence
ccuggcaaugacaaaucugc

SEQ ID NO: 55014 - RNA, 20 nt, Artificial Sequence
  CIITA targeting sequence
accauggguguacaaggaca

SEQ ID NO: 55015 - RNA, 20 nt, Artificial Sequence
  CIITA targeting sequence
uuguacacccaugguugaca

SEQ ID NO: 55016 - RNA, 20 nt, Artificial Sequence
  CIITA targeting sequence
gggugaaagaauuugugccu

SEQ ID NO: 55017 - RNA, 20 nt, Artificial Sequence
  CIITA targeting sequence
cccggauuugguuuguccuu

SEQ ID NO: 55018 - RNA, 20 nt, Artificial Sequence
  CIITA targeting sequence
uucacccggauuugguuugu

SEQ ID NO: 55019 - RNA, 20 nt, Artificial Sequence
  CIITA targeting sequence
uugccuuugaccuucagccc

SEQ ID NO: 55020 - RNA, 20 nt, Artificial Sequence
  CIITA targeting sequence
aaggcaaagaaaacaaggca

SEQ ID NO: 55021 - RNA, 20 nt, Artificial Sequence
  CIITA targeting sequence
gccccgugcauuccugcaaa

SEQ ID NO: 55022 - RNA, 20 nt, Artificial Sequence
  CIITA targeting sequence
ugcaaaugcauugccccugg

SEQ ID NO: 55023 - RNA, 20 nt, Artificial Sequence
  CIITA targeting sequence
uaagguuuaccaggggcaau

SEQ ID NO: 55024 - RNA, 20 nt, Artificial Sequence
  CIITA targeting sequence
ucuuaagguuuaccaggggc

SEQ ID NO: 55025 - RNA, 20 nt, Artificial Sequence
  CIITA targeting sequence
guuuuaagugagauuuccaa

SEQ ID NO: 55026 - RNA, 20 nt, Artificial Sequence
  CIITA targeting sequence
cuuaaaacagaaaaguuaag

SEQ ID NO: 55027 - RNA, 20 nt, Artificial Sequence
  CIITA targeting sequence
cacuuaaaacagaaaaguua

SEQ ID NO: 55028 - RNA, 20 nt, Artificial Sequence
  CIITA targeting sequence
aaguuaauuuaaguugugug

SEQ ID NO: 55029 - RNA, 20 nt, Artificial Sequence
  CIITA targeting sequence
acacaacuuaaauuaacuug

SEQ ID NO: 55030 - RNA, 20 nt, Artificial Sequence
  CIITA targeting sequence
uguuccacacaacuuaaauu

SEQ ID NO: 55031 - RNA, 20 nt, Artificial Sequence
  CIITA targeting sequence
cuuuacuggagagcaauugg

SEQ ID NO: 55032 - RNA, 20 nt, Artificial Sequence
  CIITA targeting sequence
aguaaagggaguguccuguu

SEQ ID NO: 55033 - RNA, 20 nt, Artificial Sequence
  CIITA targeting sequence
ccaguaaagggaguguccug

SEQ ID NO: 55034 - RNA, 20 nt, Artificial Sequence
  CIITA targeting sequence
gaagagaaugagauagaggu

SEQ ID NO: 55035 - RNA, 20 nt, Artificial Sequence
  CIITA targeting sequence
gauaccaauugcucuccagu

SEQ ID NO: 55036 - RNA, 20 nt, Artificial Sequence
  CIITA targeting sequence
ucagauaccaauugcucucc

SEQ ID NO: 55037 - RNA, 20 nt, Artificial Sequence
  CIITA targeting sequence
cuucagauaccaauugcucu

SEQ ID NO: 55038 - RNA, 20 nt, Artificial Sequence
  CIITA targeting sequence
uucucuucagauaccaauug

SEQ ID NO: 55039 - RNA, 20 nt, Artificial Sequence
  CIITA targeting sequence
cauucucuucagauaccaau

SEQ ID NO: 55040 - RNA, 20 nt, Artificial Sequence
  CIITA targeting sequence
aucucauucucuucagauac

SEQ ID NO: 55041 - RNA, 20 nt, Artificial Sequence
  CIITA targeting sequence
uuagcaaccucuaucucauu

SEQ ID NO: 55042 - RNA, 20 nt, Artificial Sequence
  CIITA targeting sequence
ccaauaauuuauguaaacca

SEQ ID NO: 55043 - RNA, 20 nt, Artificial Sequence
  CIITA targeting sequence
uauucaccaauaauuuaugu

SEQ ID NO: 55044 - RNA, 20 nt, Artificial Sequence
  CIITA targeting sequence
uucuuccagaugguaaacug

SEQ ID NO: 55045 - RNA, 20 nt, Artificial Sequence
  CIITA targeting sequence
uccagaugguaaacuggaag

SEQ ID NO: 55046 - RNA, 20 nt, Artificial Sequence
  CIITA targeting sequence
agaugguaaacuggaaggga

SEQ ID NO: 55047 - RNA, 20 nt, Artificial Sequence
  CIITA targeting sequence
ggaagaaggaauaaacuuau

SEQ ID NO: 55048 - RNA, 20 nt, Artificial Sequence
  CIITA targeting sequence
aguuuaccaucuggaagaag

SEQ ID NO: 55049 - RNA, 20 nt, Artificial Sequence
  CIITA targeting sequence
cuuccaguuuaccaucugga

SEQ ID NO: 55050 - RNA, 20 nt, Artificial Sequence
  CIITA targeting sequence
cuuuacccaguaacaugcuu

SEQ ID NO: 55051 - RNA, 20 nt, Artificial Sequence
  CIITA targeting sequence
ugggccgugggaggcucaga

SEQ ID NO: 55052 - RNA, 20 nt, Artificial Sequence
  CIITA targeting sequence
cacggcccaugacucacuuu

SEQ ID NO: 55053 - RNA, 20 nt, Artificial Sequence
  CIITA targeting sequence
gauggaaaagggcucuggga

SEQ ID NO: 55054 - RNA, 20 nt, Artificial Sequence
  CIITA targeting sequence
gagccucccacggcccauga

SEQ ID NO: 55055 - RNA, 20 nt, Artificial Sequence
  CIITA targeting sequence
aucugagccucccacggccc

SEQ ID NO: 55056 - RNA, 20 nt, Artificial Sequence
  CIITA targeting sequence
gggaugccucucucucucuc

SEQ ID NO: 55057 - RNA, 20 nt, Artificial Sequence
  CIITA targeting sequence
cagagcccuuuuccaucuga

SEQ ID NO: 55058 - RNA, 20 nt, Artificial Sequence
  CIITA targeting sequence
cucucucucucuuuacuugg

SEQ ID NO: 55059 - RNA, 20 nt, Artificial Sequence
  CIITA targeting sequence
cucucucucuuuacuuggga

SEQ ID NO: 55060 - RNA, 20 nt, Artificial Sequence
  CIITA targeting sequence
cucucucuuuacuugggacc

SEQ ID NO: 55061 - RNA, 20 nt, Artificial Sequence
  CIITA targeting sequence
cucucuuuacuugggacccc

SEQ ID NO: 55062 - RNA, 20 nt, Artificial Sequence
  CIITA targeting sequence
cucuuuacuugggaccccuu

SEQ ID NO: 55063 - RNA, 20 nt, Artificial Sequence
  CIITA targeting sequence
cuuuacuugggaccccuuuc

SEQ ID NO: 55064 - RNA, 20 nt, Artificial Sequence
  CIITA targeting sequence
uuacuugggaccccuuucua

SEQ ID NO: 55065 - RNA, 20 nt, Artificial Sequence
  CIITA targeting sequence
caaguaaagagagagagaga

SEQ ID NO: 55066 - RNA, 20 nt, Artificial Sequence
  CIITA targeting sequence
aauuuaccuaccaggccuca

SEQ ID NO: 55067 - RNA, 20 nt, Artificial Sequence
  CIITA targeting sequence
aaagacaaagcccucuaauc

SEQ ID NO: 55068 - RNA, 20 nt, Artificial Sequence
  CIITA targeting sequence
uuugaggccugguagguaaa

SEQ ID NO: 55069 - RNA, 20 nt, Artificial Sequence
  CIITA targeting sequence
aaucuguuuaggcaggaaca

SEQ ID NO: 55070 - RNA, 20 nt, Artificial Sequence
  CIITA targeting sequence
guuuaggcaggaacagauaa

SEQ ID NO: 55071 - RNA, 20 nt, Artificial Sequence
  CIITA targeting sequence
ugccuaaacagauuagaggg

SEQ ID NO: 55072 - RNA, 20 nt, Artificial Sequence
  CIITA targeting sequence
guuccugccuaaacagauua

SEQ ID NO: 55073 - RNA, 20 nt, Artificial Sequence
  CIITA targeting sequence
ucuggguggauggguagggg

SEQ ID NO: 55074 - RNA, 20 nt, Artificial Sequence
  CIITA targeting sequence
ggguggauggguaggggagg

SEQ ID NO: 55075 - RNA, 20 nt, Artificial Sequence
  CIITA targeting sequence
acccagaggaauuuuaucug

SEQ ID NO: 55076 - RNA, 20 nt, Artificial Sequence
  CIITA targeting sequence
ccuacccauccacccagagg

SEQ ID NO: 55077 - RNA, 20 nt, Artificial Sequence
  CIITA targeting sequence
cuccccuacccauccaccca

SEQ ID NO: 55078 - RNA, 20 nt, Artificial Sequence
  CIITA targeting sequence
uucccuccccuacccaucca

SEQ ID NO: 55079 - RNA, 20 nt, Artificial Sequence
  CIITA targeting sequence
uccuucccuccccuacccau

SEQ ID NO: 55080 - RNA, 20 nt, Artificial Sequence
  CIITA targeting sequence
gcaaacuuccuccuucccuc

SEQ ID NO: 55081 - RNA, 20 nt, Artificial Sequence
  CIITA targeting sequence
guuucugcaaacuuccuccu

SEQ ID NO: 55082 - RNA, 20 nt, Artificial Sequence
  CIITA targeting sequence
uucaguuucugcaaacuucc

SEQ ID NO: 55083 - RNA, 20 nt, Artificial Sequence
  CIITA targeting sequence
cuuucaguuucugcaaacuu

SEQ ID NO: 55084 - RNA, 20 nt, Artificial Sequence
  CIITA targeting sequence
ccccaaaaaaguucucuuuc

SEQ ID NO: 55085 - RNA, 20 nt, Artificial Sequence
  CIITA targeting sequence
ccccccaaaaaaguucucuu

SEQ ID NO: 55086 - RNA, 20 nt, Artificial Sequence
  CIITA targeting sequence
cucuccccccaaaaaaguuc

SEQ ID NO: 55087 - RNA, 20 nt, Artificial Sequence
  CIITA targeting sequence
cccucuccccccaaaaaagu

SEQ ID NO: 55088 - RNA, 20 nt, Artificial Sequence
  CIITA targeting sequence
cuuguuuaauuacaaaacca

SEQ ID NO: 55089 - RNA, 20 nt, Artificial Sequence
  CIITA targeting sequence
uguuuaauuacaaaaccaaa

SEQ ID NO: 55090 - RNA, 20 nt, Artificial Sequence
  CIITA targeting sequence
uuugcaaugccuuccuucuc

SEQ ID NO: 55091 - RNA, 20 nt, Artificial Sequence
  CIITA targeting sequence
uucuccuacuagucuuaagg

SEQ ID NO: 55092 - RNA, 20 nt, Artificial Sequence
  CIITA targeting sequence
ccuacuagucuuaaggaauu

SEQ ID NO: 55093 - RNA, 20 nt, Artificial Sequence
  CIITA targeting sequence
uacuagucuuaaggaauuga

SEQ ID NO: 55094 - RNA, 20 nt, Artificial Sequence
  CIITA targeting sequence
uaaggaauugauaaguaauu

SEQ ID NO: 55095 - RNA, 20 nt, Artificial Sequence
  CIITA targeting sequence
uuaagacuaguaggagaagg

SEQ ID NO: 55096 - RNA, 20 nt, Artificial Sequence
  CIITA targeting sequence
auuccuuaagacuaguagga

SEQ ID NO: 55097 - RNA, 20 nt, Artificial Sequence
  CIITA targeting sequence
cauaccacaaaaugcagcac

SEQ ID NO: 55098 - RNA, 20 nt, Artificial Sequence
  CIITA targeting sequence
cugauguuuuuuguuuguuu

SEQ ID NO: 55099 - RNA, 20 nt, Artificial Sequence
  CIITA targeting sequence
gauguuuuuuguuuguuuuu

SEQ ID NO: 55100 - RNA, 20 nt, Artificial Sequence
  CIITA targeting sequence
gagaaugguacacuuuaaag

SEQ ID NO: 55101 - RNA, 20 nt, Artificial Sequence
  CIITA targeting sequence
aaaacaaacaaaaaacauca

SEQ ID NO: 55102 - RNA, 20 nt, Artificial Sequence
  CIITA targeting sequence
caaaaacaaacaaaaaacau

SEQ ID NO: 55103 - RNA, 20 nt, Artificial Sequence
  CIITA targeting sequence
aucucaaaaacaaacaaaaa

SEQ ID NO: 55104 - RNA, 20 nt, Artificial Sequence
  CIITA targeting sequence
cgcucugucacccagacugg

SEQ ID NO: 55105 - RNA, 20 nt, Artificial Sequence
  CIITA targeting sequence
cucugucacccagacuggag

SEQ ID NO: 55106 - RNA, 20 nt, Artificial Sequence
  CIITA targeting sequence
gucacccagacuggaguaca

SEQ ID NO: 55107 - RNA, 20 nt, Artificial Sequence
  CIITA targeting sequence
cccagacuggaguacagugg

SEQ ID NO: 55108 - RNA, 20 nt, Artificial Sequence
  CIITA targeting sequence
gggugacagagcgagacucc

SEQ ID NO: 55109 - RNA, 20 nt, Artificial Sequence
  CIITA targeting sequence
agucugggugacagagcgag

SEQ ID NO: 55110 - RNA, 20 nt, Artificial Sequence
  CIITA targeting sequence
ugccacuguacuccagucug

SEQ ID NO: 55111 - RNA, 20 nt, Artificial Sequence
  CIITA targeting sequence
cggcucacugcaaccugcgc

SEQ ID NO: 55112 - RNA, 20 nt, Artificial Sequence
  CIITA targeting sequence
gcucacugcaaccugcgccu

SEQ ID NO: 55113 - RNA, 20 nt, Artificial Sequence
  CIITA targeting sequence
cugcaaccugcgccuccugg

SEQ ID NO: 55114 - RNA, 20 nt, Artificial Sequence
  CIITA targeting sequence
uggauucaagccauuuuucc

SEQ ID NO: 55115 - RNA, 20 nt, Artificial Sequence
  CIITA targeting sequence
aggaggcgcagguugcagug

SEQ ID NO: 55116 - RNA, 20 nt, Artificial Sequence
  CIITA targeting sequence
agccauuuuuccgccucagg

SEQ ID NO: 55117 - RNA, 20 nt, Artificial Sequence
  CIITA targeting sequence
gccucaggcucccgaguagc

SEQ ID NO: 55118 - RNA, 20 nt, Artificial Sequence
  CIITA targeting sequence
ggcucccgaguagcuggggu

SEQ ID NO: 55119 - RNA, 20 nt, Artificial Sequence
  CIITA targeting sequence
cgaguagcugggguuauagg

SEQ ID NO: 55120 - RNA, 20 nt, Artificial Sequence
  CIITA targeting sequence
ggagccugaggcggaaaaau

SEQ ID NO: 55121 - RNA, 20 nt, Artificial Sequence
  CIITA targeting sequence
ugccuggcuaaguuuuguau

SEQ ID NO: 55122 - RNA, 20 nt, Artificial Sequence
  CIITA targeting sequence
acaaaaaauacaaaacuuag

SEQ ID NO: 55123 - RNA, 20 nt, Artificial Sequence
  CIITA targeting sequence
cuacaaaaaauacaaaacuu

SEQ ID NO: 55124 - RNA, 20 nt, Artificial Sequence
  CIITA targeting sequence
ucucuacaaaaaauacaaaa

SEQ ID NO: 55125 - RNA, 20 nt, Artificial Sequence
  CIITA targeting sequence
ccauguugggcaggcugguc

SEQ ID NO: 55126 - RNA, 20 nt, Artificial Sequence
  CIITA targeting sequence
ugaacuccugacuucaggug

SEQ ID NO: 55127 - RNA, 20 nt, Artificial Sequence
  CIITA targeting sequence
agaccagccugcccaacaug

SEQ ID NO: 55128 - RNA, 20 nt, Artificial Sequence
  CIITA targeting sequence
ugacuucaggugaucugccu

SEQ ID NO: 55129 - RNA, 20 nt, Artificial Sequence
  CIITA targeting sequence
ggaguucaagaccagccugc

SEQ ID NO: 55130 - RNA, 20 nt, Artificial Sequence
  CIITA targeting sequence
ggugaucugccugccucggc

SEQ ID NO: 55131 - RNA, 20 nt, Artificial Sequence
  CIITA targeting sequence
ccugaagucaggaguucaag

SEQ ID NO: 55132 - RNA, 20 nt, Artificial Sequence
  CIITA targeting sequence
gccugccucggccucccaaa

SEQ ID NO: 55133 - RNA, 20 nt, Artificial Sequence
  CIITA targeting sequence
gccucccaaagugcugggau

SEQ ID NO: 55134 - RNA, 20 nt, Artificial Sequence
  CIITA targeting sequence
caaagugcugggauuacagg

SEQ ID NO: 55135 - RNA, 20 nt, Artificial Sequence
  CIITA targeting sequence
cagcacuuugggaggccgag

SEQ ID NO: 55136 - RNA, 20 nt, Artificial Sequence
  CIITA targeting sequence
ugccuguaaucccagcacuu

SEQ ID NO: 55137 - RNA, 20 nt, Artificial Sequence
  CIITA targeting sequence
cugguguuuaguguauacac

SEQ ID NO: 55138 - RNA, 20 nt, Artificial Sequence
  CIITA targeting sequence
gguguuuaguguauacacag

SEQ ID NO: 55139 - RNA, 20 nt, Artificial Sequence
  CIITA targeting sequence
ccacuacuaauucgagaaca

SEQ ID NO: 55140 - RNA, 20 nt, Artificial Sequence
  CIITA targeting sequence
agaacacuucaucacccuaa

SEQ ID NO: 55141 - RNA, 20 nt, Artificial Sequence
  CIITA targeting sequence
aauuaguaguggugaugguu

SEQ ID NO: 55142 - RNA, 20 nt, Artificial Sequence
  CIITA targeting sequence
cgaauuaguaguggugaugg

SEQ ID NO: 55143 - RNA, 20 nt, Artificial Sequence
  CIITA targeting sequence
ucacccuaaaagaaaugcca

SEQ ID NO: 55144 - RNA, 20 nt, Artificial Sequence
  CIITA targeting sequence
cccuaaaagaaaugccauac

SEQ ID NO: 55145 - RNA, 20 nt, Artificial Sequence
  CIITA targeting sequence
uuuagggugaugaaguguuc

SEQ ID NO: 55146 - RNA, 20 nt, Artificial Sequence
  CIITA targeting sequence
aucccacaauccucccaucc

SEQ ID NO: 55147 - RNA, 20 nt, Artificial Sequence
  CIITA targeting sequence
cacaauccucccaucccccu

SEQ ID NO: 55148 - RNA, 20 nt, Artificial Sequence
  CIITA targeting sequence
ucccaucccccucagcucuu

SEQ ID NO: 55149 - RNA, 20 nt, Artificial Sequence
  CIITA targeting sequence
caucccccucagcucuugca

SEQ ID NO: 55150 - RNA, 20 nt, Artificial Sequence
  CIITA targeting sequence
cccucagcucuugcaaucau

SEQ ID NO: 55151 - RNA, 20 nt, Artificial Sequence
  CIITA targeting sequence
gcucuugcaaucaugaaugu

SEQ ID NO: 55152 - RNA, 20 nt, Artificial Sequence
  CIITA targeting sequence
ugcaaucaugaauguacuuu

SEQ ID NO: 55153 - RNA, 20 nt, Artificial Sequence
  CIITA targeting sequence
ugaauguacuuucugucuau

SEQ ID NO: 55154 - RNA, 20 nt, Artificial Sequence
  CIITA targeting sequence
ugauugcaagagcugagggg

SEQ ID NO: 55155 - RNA, 20 nt, Artificial Sequence
  CIITA targeting sequence
gucuauaugaauuugucugu

SEQ ID NO: 55156 - RNA, 20 nt, Artificial Sequence
  CIITA targeting sequence
auaugaauuugucuguuuug

SEQ ID NO: 55157 - RNA, 20 nt, Artificial Sequence
  CIITA targeting sequence
uauagacagaaaguacauuc

SEQ ID NO: 55158 - RNA, 20 nt, Artificial Sequence
  CIITA targeting sequence
guuuuggacauuuccuucca

SEQ ID NO: 55159 - RNA, 20 nt, Artificial Sequence
  CIITA targeting sequence
aaaacagacaaauucauaua

SEQ ID NO: 55160 - RNA, 20 nt, Artificial Sequence
  CIITA targeting sequence
uuccaauguaaucauacaau

SEQ ID NO: 55161 - RNA, 20 nt, Artificial Sequence
  CIITA targeting sequence
aauguaaucauacaauaugu

SEQ ID NO: 55162 - RNA, 20 nt, Artificial Sequence
  CIITA targeting sequence
uacaauauguagcauuucgu

SEQ ID NO: 55163 - RNA, 20 nt, Artificial Sequence
  CIITA targeting sequence
ugucuggcuucuggcacuca

SEQ ID NO: 55164 - RNA, 20 nt, Artificial Sequence
  CIITA targeting sequence
ggcuucuggcacucagcaug

SEQ ID NO: 55165 - RNA, 20 nt, Artificial Sequence
  CIITA targeting sequence
ggcacucagcaugguggguu

SEQ ID NO: 55166 - RNA, 20 nt, Artificial Sequence
  CIITA targeting sequence
gcaugguggguuuuuaaaau

SEQ ID NO: 55167 - RNA, 20 nt, Artificial Sequence
  CIITA targeting sequence
aaacaacaacaaaaauuuua

SEQ ID NO: 55168 - RNA, 20 nt, Artificial Sequence
  CIITA targeting sequence
caaaacaacaacaaaaauuu

SEQ ID NO: 55169 - RNA, 20 nt, Artificial Sequence
  CIITA targeting sequence
gucucaaaacaacaacaaaa

SEQ ID NO: 55170 - RNA, 20 nt, Artificial Sequence
  CIITA targeting sequence
cacucuuucgcccaugcugg

SEQ ID NO: 55171 - RNA, 20 nt, Artificial Sequence
  CIITA targeting sequence
cucuuucgcccaugcuggag

SEQ ID NO: 55172 - RNA, 20 nt, Artificial Sequence
  CIITA targeting sequence
uucgcccaugcuggagggca

SEQ ID NO: 55173 - RNA, 20 nt, Artificial Sequence
  CIITA targeting sequence
cccaugcuggagggcagagg

SEQ ID NO: 55174 - RNA, 20 nt, Artificial Sequence
  CIITA targeting sequence
agcaugggcgaaagagugag

SEQ ID NO: 55175 - RNA, 20 nt, Artificial Sequence
  CIITA targeting sequence
gcccuccagcaugggcgaaa

SEQ ID NO: 55176 - RNA, 20 nt, Artificial Sequence
  CIITA targeting sequence
ugccucugcccuccagcaug

SEQ ID NO: 55177 - RNA, 20 nt, Artificial Sequence
  CIITA targeting sequence
cggcucacugcaaccucugc

SEQ ID NO: 55178 - RNA, 20 nt, Artificial Sequence
  CIITA targeting sequence
gcucacugcaaccucugccg

SEQ ID NO: 55179 - RNA, 20 nt, Artificial Sequence
  CIITA targeting sequence
cugcaaccucugccgcccug

SEQ ID NO: 55180 - RNA, 20 nt, Artificial Sequence
  CIITA targeting sequence
gccgcccugguucaagugau

SEQ ID NO: 55181 - RNA, 20 nt, Artificial Sequence
  CIITA targeting sequence
agugauucuucugccucagu

SEQ ID NO: 55182 - RNA, 20 nt, Artificial Sequence
  CIITA targeting sequence
cuugaaccagggcggcagag

SEQ ID NO: 55183 - RNA, 20 nt, Artificial Sequence
  CIITA targeting sequence
ucugccucagucucccaagu

SEQ ID NO: 55184 - RNA, 20 nt, Artificial Sequence
  CIITA targeting sequence
gccucagucucccaaguagc

SEQ ID NO: 55185 - RNA, 20 nt, Artificial Sequence
  CIITA targeting sequence
gucucccaaguagcuaggau

SEQ ID NO: 55186 - RNA, 20 nt, Artificial Sequence
  CIITA targeting sequence
cccaaguagcuaggauuaca

SEQ ID NO: 55187 - RNA, 20 nt, Artificial Sequence
  CIITA targeting sequence
caaguagcuaggauuacaag

SEQ ID NO: 55188 - RNA, 20 nt, Artificial Sequence
  CIITA targeting sequence
uagcuacuugggagacugag

SEQ ID NO: 55189 - RNA, 20 nt, Artificial Sequence
  CIITA targeting sequence
gcugggcaugguggcaggua

SEQ ID NO: 55190 - RNA, 20 nt, Artificial Sequence
  CIITA targeting sequence
gcccuccccaggccuccauc

SEQ ID NO: 55191 - RNA, 20 nt, Artificial Sequence
  CIITA targeting sequence
ccaggccuccauccuggguc

SEQ ID NO: 55192 - RNA, 20 nt, Artificial Sequence
  CIITA targeting sequence
auccuggguccuucccgccu

SEQ ID NO: 55193 - RNA, 20 nt, Artificial Sequence
  CIITA targeting sequence
uggguccuucccgccucugg

SEQ ID NO: 55194 - RNA, 20 nt, Artificial Sequence
  CIITA targeting sequence
uucccgccucuggguaaagg

SEQ ID NO: 55195 - RNA, 20 nt, Artificial Sequence
  CIITA targeting sequence
cgccucuggguaaaggugau

SEQ ID NO: 55196 - RNA, 20 nt, Artificial Sequence
  CIITA targeting sequence
ggguaaaggugaugucauca

SEQ ID NO: 55197 - RNA, 20 nt, Artificial Sequence
  CIITA targeting sequence
ccuuuacccagaggcgggaa

SEQ ID NO: 55198 - RNA, 20 nt, Artificial Sequence
  CIITA targeting sequence
ucacagcccuuuguguuccu

SEQ ID NO: 55199 - RNA, 20 nt, Artificial Sequence
  CIITA targeting sequence
cagcccuuuguguuccugcc

SEQ ID NO: 55200 - RNA, 20 nt, Artificial Sequence
  CIITA targeting sequence
ugcccagcaccuggcccugg

SEQ ID NO: 55201 - RNA, 20 nt, Artificial Sequence
  CIITA targeting sequence
cagggccaggugcugggcag

SEQ ID NO: 55202 - RNA, 20 nt, Artificial Sequence
  CIITA targeting sequence
cuguuugcagagugauuaaa

SEQ ID NO: 55203 - RNA, 20 nt, Artificial Sequence
  CIITA targeting sequence
gcaaacagggaaggucccag

SEQ ID NO: 55204 - RNA, 20 nt, Artificial Sequence
  CIITA targeting sequence
cucugcaaacagggaagguc

SEQ ID NO: 55205 - RNA, 20 nt, Artificial Sequence
  CIITA targeting sequence
aauuauuucuauuugguaag

SEQ ID NO: 55206 - RNA, 20 nt, Artificial Sequence
  CIITA targeting sequence
auuugguaagaagacguucc

SEQ ID NO: 55207 - RNA, 20 nt, Artificial Sequence
  CIITA targeting sequence
uaccaaauagaaauaauuag

SEQ ID NO: 55208 - RNA, 20 nt, Artificial Sequence
  CIITA targeting sequence
ucuuaccaaauagaaauaau

SEQ ID NO: 55209 - RNA, 20 nt, Artificial Sequence
  CIITA targeting sequence
cuuuaccacucccacuauau

SEQ ID NO: 55210 - RNA, 20 nt, Artificial Sequence
  CIITA targeting sequence
cacuauaucaaccccaaaau

SEQ ID NO: 55211 - RNA, 20 nt, Artificial Sequence
  CIITA targeting sequence
accccaaaauuugcacuaac

SEQ ID NO: 55212 - RNA, 20 nt, Artificial Sequence
  CIITA targeting sequence
uauuugucaauauaaaguuu

SEQ ID NO: 55213 - RNA, 20 nt, Artificial Sequence
  CIITA targeting sequence
auauaaaguuuuuuuuuucu

SEQ ID NO: 55214 - RNA, 20 nt, Artificial Sequence
  CIITA targeting sequence
cuuuuuugagacagagucuc

SEQ ID NO: 55215 - RNA, 20 nt, Artificial Sequence
  CIITA targeting sequence
uuuuugagacagagucucau

SEQ ID NO: 55216 - RNA, 20 nt, Artificial Sequence
  CIITA targeting sequence
aaaaagagaaaaaaaaaacu

SEQ ID NO: 55217 - RNA, 20 nt, Artificial Sequence
  CIITA targeting sequence
caaaaaagagaaaaaaaaaa

SEQ ID NO: 55218 - RNA, 20 nt, Artificial Sequence
  CIITA targeting sequence
gucucaaaaaagagaaaaaa

SEQ ID NO: 55219 - RNA, 20 nt, Artificial Sequence
  CIITA targeting sequence
cauucuguggcccaggcugg

SEQ ID NO: 55220 - RNA, 20 nt, Artificial Sequence
  CIITA targeting sequence
uucuguggcccaggcuggaa

SEQ ID NO: 55221 - RNA, 20 nt, Artificial Sequence
  CIITA targeting sequence
guggcccaggcuggaaugca

SEQ ID NO: 55222 - RNA, 20 nt, Artificial Sequence
  CIITA targeting sequence
agccugggccacagaaugag

SEQ ID NO: 55223 - RNA, 20 nt, Artificial Sequence
  CIITA targeting sequence
cgccacugcauuccagccug

SEQ ID NO: 55224 - RNA, 20 nt, Artificial Sequence
  CIITA targeting sequence
cugcaaccucugccucccag

SEQ ID NO: 55225 - RNA, 20 nt, Artificial Sequence
  CIITA targeting sequence
gccucccagguucaagcgau

SEQ ID NO: 55226 - RNA, 20 nt, Artificial Sequence
  CIITA targeting sequence
cagguucaagcgauucuccu

SEQ ID NO: 55227 - RNA, 20 nt, Artificial Sequence
  CIITA targeting sequence
agcgauucuccugccucagc

SEQ ID NO: 55228 - RNA, 20 nt, Artificial Sequence
  CIITA targeting sequence
cuugaaccugggaggcagag

SEQ ID NO: 55229 - RNA, 20 nt, Artificial Sequence
  CIITA targeting sequence
ccugccucagccucccaaau

SEQ ID NO: 55230 - RNA, 20 nt, Artificial Sequence
  CIITA targeting sequence
ugccucagccucccaaauag

SEQ ID NO: 55231 - RNA, 20 nt, Artificial Sequence
  CIITA targeting sequence
gccucccaaauagcugggau

SEQ ID NO: 55232 - RNA, 20 nt, Artificial Sequence
  CIITA targeting sequence
caaauagcugggauuacagg

SEQ ID NO: 55233 - RNA, 20 nt, Artificial Sequence
  CIITA targeting sequence
cagcuauuugggaggcugag

SEQ ID NO: 55234 - RNA, 20 nt, Artificial Sequence
  CIITA targeting sequence
gcucauuuuuuuauuuuuag

SEQ ID NO: 55235 - RNA, 20 nt, Artificial Sequence
  CIITA targeting sequence
uuuuuuuauuuuuaguagag

SEQ ID NO: 55236 - RNA, 20 nt, Artificial Sequence
  CIITA targeting sequence
acuaaaaauaaaaaaaugag

SEQ ID NO: 55237 - RNA, 20 nt, Artificial Sequence
  CIITA targeting sequence
cuacuaaaaauaaaaaaaug

SEQ ID NO: 55238 - RNA, 20 nt, Artificial Sequence
  CIITA targeting sequence
ccauguuggccaggcugguc

SEQ ID NO: 55239 - RNA, 20 nt, Artificial Sequence
  CIITA targeting sequence
cgaacuccugaccucaagug

SEQ ID NO: 55240 - RNA, 20 nt, Artificial Sequence
  CIITA targeting sequence
aacuccugaccucaagugau

SEQ ID NO: 55241 - RNA, 20 nt, Artificial Sequence
  CIITA targeting sequence
agaccagccuggccaacaug

SEQ ID NO: 55242 - RNA, 20 nt, Artificial Sequence
  CIITA targeting sequence
ugaccucaagugauccgccc

SEQ ID NO: 55243 - RNA, 20 nt, Artificial Sequence
  CIITA targeting sequence
ggaguucgagaccagccugg

SEQ ID NO: 55244 - RNA, 20 nt, Artificial Sequence
  CIITA targeting sequence
agugauccgcccaccucggc

SEQ ID NO: 55245 - RNA, 20 nt, Artificial Sequence
  CIITA targeting sequence
cuugaggucaggaguucgag

SEQ ID NO: 55246 - RNA, 20 nt, Artificial Sequence
  CIITA targeting sequence
gcccaccucggccucccaaa

SEQ ID NO: 55247 - RNA, 20 nt, Artificial Sequence
  CIITA targeting sequence
gccucccaaagugcuggcau

SEQ ID NO: 55248 - RNA, 20 nt, Artificial Sequence
  CIITA targeting sequence
caaagugcuggcauuacagg

SEQ ID NO: 55249 - RNA, 20 nt, Artificial Sequence
  CIITA targeting sequence
cgccuguaaugccagcacuu

SEQ ID NO: 55250 - RNA, 20 nt, Artificial Sequence
  CIITA targeting sequence
uuuuuuuucauguugcacua

SEQ ID NO: 55251 - RNA, 20 nt, Artificial Sequence
  CIITA targeting sequence
uguugcacuaugauccaguu

SEQ ID NO: 55252 - RNA, 20 nt, Artificial Sequence
  CIITA targeting sequence
uagugcaacaugaaaaaaaa

SEQ ID NO: 55253 - RNA, 20 nt, Artificial Sequence
  CIITA targeting sequence
aguuuuccuccaggggguuc

SEQ ID NO: 55254 - RNA, 20 nt, Artificial Sequence
  CIITA targeting sequence
uccaggggguucuaaacacc

SEQ ID NO: 55255 - RNA, 20 nt, Artificial Sequence
  CIITA targeting sequence
aggggguucuaaacaccaau

SEQ ID NO: 55256 - RNA, 20 nt, Artificial Sequence
  CIITA targeting sequence
aaacaccaaugguggacaaa

SEQ ID NO: 55257 - RNA, 20 nt, Artificial Sequence
  CIITA targeting sequence
accauugguguuuagaaccc

SEQ ID NO: 55258 - RNA, 20 nt, Artificial Sequence
  CIITA targeting sequence
uuuguccaccauugguguuu

SEQ ID NO: 55259 - RNA, 20 nt, Artificial Sequence
  CIITA targeting sequence
auccuuuguccaccauuggu

SEQ ID NO: 55260 - RNA, 20 nt, Artificial Sequence
  CIITA targeting sequence
caauccuuuguccaccauug

SEQ ID NO: 55261 - RNA, 20 nt, Artificial Sequence
  CIITA targeting sequence
cucaauccuuuguccaccau

SEQ ID NO: 55262 - RNA, 20 nt, Artificial Sequence
  CIITA targeting sequence
acaucucucaauccuuuguc

SEQ ID NO: 55263 - RNA, 20 nt, Artificial Sequence
  CIITA targeting sequence
cuugccggccuuaugggacc

SEQ ID NO: 55264 - RNA, 20 nt, Artificial Sequence
  CIITA targeting sequence
cauaaggccggcaagggagg

SEQ ID NO: 55265 - RNA, 20 nt, Artificial Sequence
  CIITA targeting sequence
cuauaugggucccauaaggc

SEQ ID NO: 55266 - RNA, 20 nt, Artificial Sequence
  CIITA targeting sequence
accaacaggggcagaugugg

SEQ ID NO: 55267 - RNA, 20 nt, Artificial Sequence
  CIITA targeting sequence
gccccuguugguugacuuug

SEQ ID NO: 55268 - RNA, 20 nt, Artificial Sequence
  CIITA targeting sequence
cacaucugccccuguugguu

SEQ ID NO: 55269 - RNA, 20 nt, Artificial Sequence
  CIITA targeting sequence
cccacaucugccccuguugg

SEQ ID NO: 55270 - RNA, 20 nt, Artificial Sequence
  CIITA targeting sequence
cucccacaucugccccuguu

SEQ ID NO: 55271 - RNA, 20 nt, Artificial Sequence
  CIITA targeting sequence
uaucucucccacaucugccc

SEQ ID NO: 55272 - RNA, 20 nt, Artificial Sequence
  CIITA targeting sequence
ccuucauaucucucccacau

SEQ ID NO: 55273 - RNA, 20 nt, Artificial Sequence
  CIITA targeting sequence
ccccuucauaucucucccac

SEQ ID NO: 55274 - RNA, 20 nt, Artificial Sequence
  CIITA targeting sequence
uuuuuuguuuugggaggggu

SEQ ID NO: 55275 - RNA, 20 nt, Artificial Sequence
  CIITA targeting sequence
caaaacaaaaaaagaaacua

SEQ ID NO: 55276 - RNA, 20 nt, Artificial Sequence
  CIITA targeting sequence
uaggagcgaguggaggaucu

SEQ ID NO: 55277 - RNA, 20 nt, Artificial Sequence
  CIITA targeting sequence
uaggaaccguaccccuccca

SEQ ID NO: 55278 - RNA, 20 nt, Artificial Sequence
  CIITA targeting sequence
cuccuaggaaccguaccccu

SEQ ID NO: 55279 - RNA, 20 nt, Artificial Sequence
  CIITA targeting sequence
acucgcuccuaggaaccgua

SEQ ID NO: 55280 - RNA, 20 nt, Artificial Sequence
  CIITA targeting sequence
uccacucgcuccuaggaacc

SEQ ID NO: 55281 - RNA, 20 nt, Artificial Sequence
  CIITA targeting sequence
ggggacaagggcaagggggc

SEQ ID NO: 55282 - RNA, 20 nt, Artificial Sequence
  CIITA targeting sequence
ccagauccuccacucgcucc

SEQ ID NO: 55283 - RNA, 20 nt, Artificial Sequence
  CIITA targeting sequence
gcccccuugcccuugucccc

SEQ ID NO: 55284 - RNA, 20 nt, Artificial Sequence
  CIITA targeting sequence
ggguacagcggggacagaca

SEQ ID NO: 55285 - RNA, 20 nt, Artificial Sequence
  CIITA targeting sequence
ccgcuguacccagaucugcc

SEQ ID NO: 55286 - RNA, 20 nt, Artificial Sequence
  CIITA targeting sequence
guccccgcuguacccagauc

SEQ ID NO: 55287 - RNA, 20 nt, Artificial Sequence
  CIITA targeting sequence
gggugucuguccccgcugua

SEQ ID NO: 55288 - RNA, 20 nt, Artificial Sequence
  CIITA targeting sequence
cguggggcaggugaguagug

SEQ ID NO: 55289 - RNA, 20 nt, Artificial Sequence
  CIITA targeting sequence
ccugccccacgggacacagg

SEQ ID NO: 55290 - RNA, 20 nt, Artificial Sequence
  CIITA targeting sequence
uggccccgcacuacucaccu

SEQ ID NO: 55291 - RNA, 20 nt, Artificial Sequence
  CIITA targeting sequence
cuuuccuggccccgcacuac

SEQ ID NO: 55292 - RNA, 20 nt, Artificial Sequence
  CIITA targeting sequence
uguuacaggagccuucacau

SEQ ID NO: 55293 - RNA, 20 nt, Artificial Sequence
  CIITA targeting sequence
uguaacacgaccucacuuuc

SEQ ID NO: 55294 - RNA, 20 nt, Artificial Sequence
  CIITA targeting sequence
caucacaaggugggcaccag

SEQ ID NO: 55295 - RNA, 20 nt, Artificial Sequence
  CIITA targeting sequence
caaggugggcaccagcgccu

SEQ ID NO: 55296 - RNA, 20 nt, Artificial Sequence
  CIITA targeting sequence
cccauaaacccaggcgcugg

SEQ ID NO: 55297 - RNA, 20 nt, Artificial Sequence
  CIITA targeting sequence
auuucaaaaaccagcagucc

SEQ ID NO: 55298 - RNA, 20 nt, Artificial Sequence
  CIITA targeting sequence
aaaaccagcaguccaagaac

SEQ ID NO: 55299 - RNA, 20 nt, Artificial Sequence
  CIITA targeting sequence
aagaacaacuugaaaacccc

SEQ ID NO: 55300 - RNA, 20 nt, Artificial Sequence
  CIITA targeting sequence
uggacugcugguuuuugaaa

SEQ ID NO: 55301 - RNA, 20 nt, Artificial Sequence
  CIITA targeting sequence
aguuguucuuggacugcugg

SEQ ID NO: 55302 - RNA, 20 nt, Artificial Sequence
  CIITA targeting sequence
cccuggggguuuucaaguug

SEQ ID NO: 55303 - RNA, 20 nt, Artificial Sequence
  CIITA targeting sequence
acuccugccaagaaggagag

SEQ ID NO: 55304 - RNA, 20 nt, Artificial Sequence
  CIITA targeting sequence
ugccaagaaggagaguucag

SEQ ID NO: 55305 - RNA, 20 nt, Artificial Sequence
  CIITA targeting sequence
uggcaggaguugaauccccc

SEQ ID NO: 55306 - RNA, 20 nt, Artificial Sequence
  CIITA targeting sequence
uucuuggcaggaguugaauc

SEQ ID NO: 55307 - RNA, 20 nt, Artificial Sequence
  CIITA targeting sequence
ccuucuuggcaggaguugaa

SEQ ID NO: 55308 - RNA, 20 nt, Artificial Sequence
  CIITA targeting sequence
gagucuaaaaauaagcuuca

SEQ ID NO: 55309 - RNA, 20 nt, Artificial Sequence
  CIITA targeting sequence
gaacucuccuucuuggcagg

SEQ ID NO: 55310 - RNA, 20 nt, Artificial Sequence
  CIITA targeting sequence
aaaaauaagcuucaaaaccg

SEQ ID NO: 55311 - RNA, 20 nt, Artificial Sequence
  CIITA targeting sequence
aaaccgagaauaccaagaga

SEQ ID NO: 55312 - RNA, 20 nt, Artificial Sequence
  CIITA targeting sequence
guuuugaagcuuauuuuuag

SEQ ID NO: 55313 - RNA, 20 nt, Artificial Sequence
  CIITA targeting sequence
cgguuuugaagcuuauuuuu

SEQ ID NO: 55314 - RNA, 20 nt, Artificial Sequence
  CIITA targeting sequence
ugguauucucgguuuugaag

SEQ ID NO: 55315 - RNA, 20 nt, Artificial Sequence
  CIITA targeting sequence
cuugguauucucgguuuuga

SEQ ID NO: 55316 - RNA, 20 nt, Artificial Sequence
  CIITA targeting sequence
gcggugggugguucucuugg

SEQ ID NO: 55317 - RNA, 20 nt, Artificial Sequence
  CIITA targeting sequence
caacaacucgcggucagcgu

SEQ ID NO: 55318 - RNA, 20 nt, Artificial Sequence
  CIITA targeting sequence
cggucagcguaaacacacau

SEQ ID NO: 55319 - RNA, 20 nt, Artificial Sequence
  CIITA targeting sequence
gcguaaacacacaucaaagg

SEQ ID NO: 55320 - RNA, 20 nt, Artificial Sequence
  CIITA targeting sequence
aaggucucacggcccacggc

SEQ ID NO: 55321 - RNA, 20 nt, Artificial Sequence
  CIITA targeting sequence
cacggcccacggccaagggu

SEQ ID NO: 55322 - RNA, 20 nt, Artificial Sequence
  CIITA targeting sequence
cggcccacggccaagggugu

SEQ ID NO: 55323 - RNA, 20 nt, Artificial Sequence
  CIITA targeting sequence
ucucccgagaacacaaaaaa

SEQ ID NO: 55324 - RNA, 20 nt, Artificial Sequence
  CIITA targeting sequence
cccgagaacacaaaaaacca

SEQ ID NO: 55325 - RNA, 20 nt, Artificial Sequence
  CIITA targeting sequence
cgagaacacaaaaaaccaag

SEQ ID NO: 55326 - RNA, 20 nt, Artificial Sequence
  CIITA targeting sequence
ggagaagacacccuuggccg

SEQ ID NO: 55327 - RNA, 20 nt, Artificial Sequence
  CIITA targeting sequence
cgggagaagacacccuuggc

SEQ ID NO: 55328 - RNA, 20 nt, Artificial Sequence
  CIITA targeting sequence
acuugguuuuuuguguucuc

SEQ ID NO: 55329 - RNA, 20 nt, Artificial Sequence
  CIITA targeting sequence
gcuguguuucaacuugguuu

SEQ ID NO: 55330 - RNA, 20 nt, Artificial Sequence
  CIITA targeting sequence
ccauagcuucugguguugcu

SEQ ID NO: 55331 - RNA, 20 nt, Artificial Sequence
  CIITA targeting sequence
auagcuucugguguugcuuc

SEQ ID NO: 55332 - RNA, 20 nt, Artificial Sequence
  CIITA targeting sequence
gguguugcuucauucugacc

SEQ ID NO: 55333 - RNA, 20 nt, Artificial Sequence
  CIITA targeting sequence
uucugacccacagccucugu

SEQ ID NO: 55334 - RNA, 20 nt, Artificial Sequence
  CIITA targeting sequence
gacccacagccucuguaaac

SEQ ID NO: 55335 - RNA, 20 nt, Artificial Sequence
  CIITA targeting sequence
gaaugaagcaacaccagaag

SEQ ID NO: 55336 - RNA, 20 nt, Artificial Sequence
  CIITA targeting sequence
guaaacauucccccgaaaaa

SEQ ID NO: 55337 - RNA, 20 nt, Artificial Sequence
  CIITA targeting sequence
cccgaaaaaaguaucuuaac

SEQ ID NO: 55338 - RNA, 20 nt, Artificial Sequence
  CIITA targeting sequence
ggggaauguuuacagaggcu

SEQ ID NO: 55339 - RNA, 20 nt, Artificial Sequence
  CIITA targeting sequence
uaaccuuuuucuuuucuuuu

SEQ ID NO: 55340 - RNA, 20 nt, Artificial Sequence
  CIITA targeting sequence
uuucuuuuuucuuucuuaaa

SEQ ID NO: 55341 - RNA, 20 nt, Artificial Sequence
  CIITA targeting sequence
uuuuucuuucuuaaacugaa

SEQ ID NO: 55342 - RNA, 20 nt, Artificial Sequence
  CIITA targeting sequence
uucuuaaacugaacuuuguu

SEQ ID NO: 55343 - RNA, 20 nt, Artificial Sequence
  CIITA targeting sequence
uaaacugaacuuuguuuuac

SEQ ID NO: 55344 - RNA, 20 nt, Artificial Sequence
  CIITA targeting sequence
guuuaagaaagaaaaaagaa

SEQ ID NO: 55345 - RNA, 20 nt, Artificial Sequence
  CIITA targeting sequence
gggucucgcuguguugccaa

SEQ ID NO: 55346 - RNA, 20 nt, Artificial Sequence
  CIITA targeting sequence
cgcuguguugccaaggcugc

SEQ ID NO: 55347 - RNA, 20 nt, Artificial Sequence
  CIITA targeting sequence
cuguguugccaaggcugcag

SEQ ID NO: 55348 - RNA, 20 nt, Artificial Sequence
  CIITA targeting sequence
uagcuuacuacagccuugaa

SEQ ID NO: 55349 - RNA, 20 nt, Artificial Sequence
  CIITA targeting sequence
aggcuguaguaagcuaugau

SEQ ID NO: 55350 - RNA, 20 nt, Artificial Sequence
  CIITA targeting sequence
uggguucgagugauccuccc

SEQ ID NO: 55351 - RNA, 20 nt, Artificial Sequence
  CIITA targeting sequence
agugauccucccacuucagc

SEQ ID NO: 55352 - RNA, 20 nt, Artificial Sequence
  CIITA targeting sequence
aacccaggaguucaaggcug

SEQ ID NO: 55353 - RNA, 20 nt, Artificial Sequence
  CIITA targeting sequence
cucgaacccaggaguucaag

SEQ ID NO: 55354 - RNA, 20 nt, Artificial Sequence
  CIITA targeting sequence
ucccacuucagccucucgac

SEQ ID NO: 55355 - RNA, 20 nt, Artificial Sequence
  CIITA targeting sequence
cacuucagccucucgaccag

SEQ ID NO: 55356 - RNA, 20 nt, Artificial Sequence
  CIITA targeting sequence
gccucucgaccagcugggac

SEQ ID NO: 55357 - RNA, 20 nt, Artificial Sequence
  CIITA targeting sequence
cgaccagcugggacuccagg

SEQ ID NO: 55358 - RNA, 20 nt, Artificial Sequence
  CIITA targeting sequence
accagcugggacuccaggca

SEQ ID NO: 55359 - RNA, 20 nt, Artificial Sequence
  CIITA targeting sequence
agaggcugaagugggaggau

SEQ ID NO: 55360 - RNA, 20 nt, Artificial Sequence
  CIITA targeting sequence
cagcuggucgagaggcugaa

SEQ ID NO: 55361 - RNA, 20 nt, Artificial Sequence
  CIITA targeting sequence
aggcacaugccaccaugauu

SEQ ID NO: 55362 - RNA, 20 nt, Artificial Sequence
  CIITA targeting sequence
ugguggcaugugccuggagu

SEQ ID NO: 55363 - RNA, 20 nt, Artificial Sequence
  CIITA targeting sequence
acaaaaaauuaaaaauuaaa

SEQ ID NO: 55364 - RNA, 20 nt, Artificial Sequence
  CIITA targeting sequence
cuacaaaaaauuaaaaauua

SEQ ID NO: 55365 - RNA, 20 nt, Artificial Sequence
  CIITA targeting sequence
cacuauguugcccaggcugg

SEQ ID NO: 55366 - RNA, 20 nt, Artificial Sequence
  CIITA targeting sequence
cuauguugcccaggcuggcc

SEQ ID NO: 55367 - RNA, 20 nt, Artificial Sequence
  CIITA targeting sequence
agugauccucccaaagcguu

SEQ ID NO: 55368 - RNA, 20 nt, Artificial Sequence
  CIITA targeting sequence
cuugaggccagccugggcaa

SEQ ID NO: 55369 - RNA, 20 nt, Artificial Sequence
  CIITA targeting sequence
ucccaaagcguugggauuac

SEQ ID NO: 55370 - RNA, 20 nt, Artificial Sequence
  CIITA targeting sequence
caaagcguugggauuacagg

SEQ ID NO: 55371 - RNA, 20 nt, Artificial Sequence
  CIITA targeting sequence
caacgcuuugggaggaucac

SEQ ID NO: 55372 - RNA, 20 nt, Artificial Sequence
  CIITA targeting sequence
gccuuaaucuuuuucuaaaa

SEQ ID NO: 55373 - RNA, 20 nt, Artificial Sequence
  CIITA targeting sequence
uuuucuaaaaucgaucccag

SEQ ID NO: 55374 - RNA, 20 nt, Artificial Sequence
  CIITA targeting sequence
aaaaucgaucccagcugggc

SEQ ID NO: 55375 - RNA, 20 nt, Artificial Sequence
  CIITA targeting sequence
aucccagcugggcacggugg

SEQ ID NO: 55376 - RNA, 20 nt, Artificial Sequence
  CIITA targeting sequence
auuuuagaaaaagauuaagg

SEQ ID NO: 55377 - RNA, 20 nt, Artificial Sequence
  CIITA targeting sequence
cagcugggcacgguggcuca

SEQ ID NO: 55378 - RNA, 20 nt, Artificial Sequence
  CIITA targeting sequence
ugccuguaaucccagugcuu

SEQ ID NO: 55379 - RNA, 20 nt, Artificial Sequence
  CIITA targeting sequence
cagugcuuugggaggccgag

SEQ ID NO: 55380 - RNA, 20 nt, Artificial Sequence
  CIITA targeting sequence
caaagcacugggauuacagg

SEQ ID NO: 55381 - RNA, 20 nt, Artificial Sequence
  CIITA targeting sequence
gccucccaaagcacugggau

SEQ ID NO: 55382 - RNA, 20 nt, Artificial Sequence
  CIITA targeting sequence
cccgccucggccucccaaag

SEQ ID NO: 55383 - RNA, 20 nt, Artificial Sequence
  CIITA targeting sequence
cuugaggucaggaguucgag

SEQ ID NO: 55384 - RNA, 20 nt, Artificial Sequence
  CIITA targeting sequence
agugauucacccgccucggc

SEQ ID NO: 55385 - RNA, 20 nt, Artificial Sequence
  CIITA targeting sequence
ggaguucgagaccagccugg

SEQ ID NO: 55386 - RNA, 20 nt, Artificial Sequence
  CIITA targeting sequence
ugaccucaagugauucaccc

SEQ ID NO: 55387 - RNA, 20 nt, Artificial Sequence
  CIITA targeting sequence
agaccagccuggccaacaug

SEQ ID NO: 55388 - RNA, 20 nt, Artificial Sequence
  CIITA targeting sequence
aacuccugaccucaagugau

SEQ ID NO: 55389 - RNA, 20 nt, Artificial Sequence
  CIITA targeting sequence
cgaacuccugaccucaagug

SEQ ID NO: 55390 - RNA, 20 nt, Artificial Sequence
  CIITA targeting sequence
ccauguuggccaggcugguc

SEQ ID NO: 55391 - RNA, 20 nt, Artificial Sequence
  CIITA targeting sequence
cuacuaaaaauccaaaaauu

SEQ ID NO: 55392 - RNA, 20 nt, Artificial Sequence
  CIITA targeting sequence
acuaaaaauccaaaaauuag

SEQ ID NO: 55393 - RNA, 20 nt, Artificial Sequence
  CIITA targeting sequence
aaaaauuagcugggcaaggu

SEQ ID NO: 55394 - RNA, 20 nt, Artificial Sequence
  CIITA targeting sequence
caguuacuccagaggcuaag

SEQ ID NO: 55395 - RNA, 20 nt, Artificial Sequence
  CIITA targeting sequence
agaggcuaaggcaugagaau

SEQ ID NO: 55396 - RNA, 20 nt, Artificial Sequence
  CIITA targeting sequence
ggaguaacugggacuacagg

SEQ ID NO: 55397 - RNA, 20 nt, Artificial Sequence
  CIITA targeting sequence
ugccuuagccucuggaguaa

SEQ ID NO: 55398 - RNA, 20 nt, Artificial Sequence
  CIITA targeting sequence
caugccuuagccucuggagu

SEQ ID NO: 55399 - RNA, 20 nt, Artificial Sequence
  CIITA targeting sequence
agcaauucucaugccuuagc

SEQ ID NO: 55400 - RNA, 20 nt, Artificial Sequence
  CIITA targeting sequence
cagguucaagcaauucucau

SEQ ID NO: 55401 - RNA, 20 nt, Artificial Sequence
  CIITA targeting sequence
accucccagguucaagcaau

SEQ ID NO: 55402 - RNA, 20 nt, Artificial Sequence
  CIITA targeting sequence
cugcaaccuccaccucccag

SEQ ID NO: 55403 - RNA, 20 nt, Artificial Sequence
  CIITA targeting sequence
gcucacugcaaccuccaccu

SEQ ID NO: 55404 - RNA, 20 nt, Artificial Sequence
  CIITA targeting sequence
cagcucacugcaaccuccac

SEQ ID NO: 55405 - RNA, 20 nt, Artificial Sequence
  CIITA targeting sequence
caccacugcacuccagccua

SEQ ID NO: 55406 - RNA, 20 nt, Artificial Sequence
  CIITA targeting sequence
agccuaggcaacagagcaag

SEQ ID NO: 55407 - RNA, 20 nt, Artificial Sequence
  CIITA targeting sequence
guugccuaggcuggagugca

SEQ ID NO: 55408 - RNA, 20 nt, Artificial Sequence
  CIITA targeting sequence
ugcucuguugccuaggcugg

SEQ ID NO: 55409 - RNA, 20 nt, Artificial Sequence
  CIITA targeting sequence
caaaauaaauaaauaaguaa

SEQ ID NO: 55410 - RNA, 20 nt, Artificial Sequence
  CIITA targeting sequence
aaauaaauaaauaaguaaau

SEQ ID NO: 55411 - RNA, 20 nt, Artificial Sequence
  CIITA targeting sequence
cauauuccccucuccuuucu

SEQ ID NO: 55412 - RNA, 20 nt, Artificial Sequence
  CIITA targeting sequence
ccucuccuuucuuacaaucu

SEQ ID NO: 55413 - RNA, 20 nt, Artificial Sequence
  CIITA targeting sequence
ccuuucuuacaaucugcaaa

SEQ ID NO: 55414 - RNA, 20 nt, Artificial Sequence
  CIITA targeting sequence
uuucuuacaaucugcaaaaa

SEQ ID NO: 55415 - RNA, 20 nt, Artificial Sequence
  CIITA targeting sequence
uacaaucugcaaaaaaaaaa

SEQ ID NO: 55416 - RNA, 20 nt, Artificial Sequence
  CIITA targeting sequence
gcaaaaaaaaaaaaaaaaaa

SEQ ID NO: 55417 - RNA, 20 nt, Artificial Sequence
  CIITA targeting sequence
uuuuuuuuuuuuuuuuuuuu

SEQ ID NO: 55418 - RNA, 20 nt, Artificial Sequence
  CIITA targeting sequence
cuuuuuuuuuuuuuuuuuuu

SEQ ID NO: 55419 - RNA, 20 nt, Artificial Sequence
  CIITA targeting sequence
cucuuuuuuuuuuuuuuuuu

SEQ ID NO: 55420 - RNA, 20 nt, Artificial Sequence
  CIITA targeting sequence
cucucuuuuuuuuuuuuuuu

SEQ ID NO: 55421 - RNA, 20 nt, Artificial Sequence
  CIITA targeting sequence
cucucucuuuuuuuuuuuuu

SEQ ID NO: 55422 - RNA, 20 nt, Artificial Sequence
  CIITA targeting sequence
uucucucucucuuuuuuuuu

SEQ ID NO: 55423 - RNA, 20 nt, Artificial Sequence
  CIITA targeting sequence
cuuucucucucucuuuuuuu

SEQ ID NO: 55424 - RNA, 20 nt, Artificial Sequence
  CIITA targeting sequence
uuuucucuuucucucucucu

SEQ ID NO: 55425 - RNA, 20 nt, Artificial Sequence
  CIITA targeting sequence
cuuuuucucuuucucucucu

SEQ ID NO: 55426 - RNA, 20 nt, Artificial Sequence
  CIITA targeting sequence
uuucucuuuuucucuuucuc

SEQ ID NO: 55427 - RNA, 20 nt, Artificial Sequence
  CIITA targeting sequence
uuuccuuucucuuuuucucu

SEQ ID NO: 55428 - RNA, 20 nt, Artificial Sequence
  CIITA targeting sequence
acaucugugguucuacacgg

SEQ ID NO: 55429 - RNA, 20 nt, Artificial Sequence
  CIITA targeting sequence
gugguucuacacggucccag

SEQ ID NO: 55430 - RNA, 20 nt, Artificial Sequence
  CIITA targeting sequence
acacggucccaggcugccaa

SEQ ID NO: 55431 - RNA, 20 nt, Artificial Sequence
  CIITA targeting sequence
caggcugccaacaguccaac

SEQ ID NO: 55432 - RNA, 20 nt, Artificial Sequence
  CIITA targeting sequence
aacauggggcugauggcggc

SEQ ID NO: 55433 - RNA, 20 nt, Artificial Sequence
  CIITA targeting sequence
gccccauguuggacuguugg

SEQ ID NO: 55434 - RNA, 20 nt, Artificial Sequence
  CIITA targeting sequence
aucccaccaacacaauuugc

SEQ ID NO: 55435 - RNA, 20 nt, Artificial Sequence
  CIITA targeting sequence
caccaacacaauuugcuacu

SEQ ID NO: 55436 - RNA, 20 nt, Artificial Sequence
  CIITA targeting sequence
aagccucugaggacuuggac

SEQ ID NO: 55437 - RNA, 20 nt, Artificial Sequence
  CIITA targeting sequence
gaggacuuggacaccagcag

SEQ ID NO: 55438 - RNA, 20 nt, Artificial Sequence
  CIITA targeting sequence
gaggcuuugaaguagcaaau

SEQ ID NO: 55439 - RNA, 20 nt, Artificial Sequence
  CIITA targeting sequence
ucagaggcuuugaaguagca

SEQ ID NO: 55440 - RNA, 20 nt, Artificial Sequence
  CIITA targeting sequence
aaguccucagaggcuuugaa

SEQ ID NO: 55441 - RNA, 20 nt, Artificial Sequence
  CIITA targeting sequence
gcugguguccaaguccucag

SEQ ID NO: 55442 - RNA, 20 nt, Artificial Sequence
  CIITA targeting sequence
uugcacgcuggguucugcug

SEQ ID NO: 55443 - RNA, 20 nt, Artificial Sequence
  CIITA targeting sequence
guguaaaguaagaguucaua

SEQ ID NO: 55444 - RNA, 20 nt, Artificial Sequence
  CIITA targeting sequence
uacuuuacacagaguccuug

SEQ ID NO: 55445 - RNA, 20 nt, Artificial Sequence
  CIITA targeting sequence
uaguugccgugggcgccucc

SEQ ID NO: 55446 - RNA, 20 nt, Artificial Sequence
  CIITA targeting sequence
ucugagugagguaaacaggc

SEQ ID NO: 55447 - RNA, 20 nt, Artificial Sequence
  CIITA targeting sequence
gagugagguaaacaggcuug

SEQ ID NO: 55448 - RNA, 20 nt, Artificial Sequence
  CIITA targeting sequence
gaggaggcgcccacggcaac

SEQ ID NO: 55449 - RNA, 20 nt, Artificial Sequence
  CIITA targeting sequence
cucagaggaggcgcccacgg

SEQ ID NO: 55450 - RNA, 20 nt, Artificial Sequence
  CIITA targeting sequence
gcuuugaugauaaauauaua

SEQ ID NO: 55451 - RNA, 20 nt, Artificial Sequence
  CIITA targeting sequence
aagcagaugcccaagccugu

SEQ ID NO: 55452 - RNA, 20 nt, Artificial Sequence
  CIITA targeting sequence
ucaaagcagaugcccaagcc

SEQ ID NO: 55453 - RNA, 20 nt, Artificial Sequence
  CIITA targeting sequence
caaauaagguauauauuuau

SEQ ID NO: 55454 - RNA, 20 nt, Artificial Sequence
  CIITA targeting sequence
ucuauuugcuuacuuccuuu

SEQ ID NO: 55455 - RNA, 20 nt, Artificial Sequence
  CIITA targeting sequence
auuugcuuacuuccuuuguu

SEQ ID NO: 55456 - RNA, 20 nt, Artificial Sequence
  CIITA targeting sequence
uuuguucuggccaaauucca

SEQ ID NO: 55457 - RNA, 20 nt, Artificial Sequence
  CIITA targeting sequence
ggccaaauuccagaugacug

SEQ ID NO: 55458 - RNA, 20 nt, Artificial Sequence
  CIITA targeting sequence
agaugacugcagguagucca

SEQ ID NO: 55459 - RNA, 20 nt, Artificial Sequence
  CIITA targeting sequence
ggaauuuggccagaacaaag

SEQ ID NO: 55460 - RNA, 20 nt, Artificial Sequence
  CIITA targeting sequence
ucuggaauuuggccagaaca

SEQ ID NO: 55461 - RNA, 20 nt, Artificial Sequence
  CIITA targeting sequence
aacugucugucuuugaaaau

SEQ ID NO: 55462 - RNA, 20 nt, Artificial Sequence
  CIITA targeting sequence
gucuuugaaaauuccagaaa

SEQ ID NO: 55463 - RNA, 20 nt, Artificial Sequence
  CIITA targeting sequence
uugaaaauuccagaaaacag

SEQ ID NO: 55464 - RNA, 20 nt, Artificial Sequence
  CIITA targeting sequence
aagacagacaguuggacuac

SEQ ID NO: 55465 - RNA, 20 nt, Artificial Sequence
  CIITA targeting sequence
agaaaacagcaaucuugccu

SEQ ID NO: 55466 - RNA, 20 nt, Artificial Sequence
  CIITA targeting sequence
ggaauuuucaaagacagaca

SEQ ID NO: 55467 - RNA, 20 nt, Artificial Sequence
  CIITA targeting sequence
ugccuuuagcaagacuuacg

SEQ ID NO: 55468 - RNA, 20 nt, Artificial Sequence
  CIITA targeting sequence
ugcuaaaggcaagauugcug

SEQ ID NO: 55469 - RNA, 20 nt, Artificial Sequence
  CIITA targeting sequence
guaagucuugcuaaaggcaa

SEQ ID NO: 55470 - RNA, 20 nt, Artificial Sequence
  CIITA targeting sequence
cacauuauccguaagucuug

SEQ ID NO: 55471 - RNA, 20 nt, Artificial Sequence
  CIITA targeting sequence
accaccacccuguucccaca

SEQ ID NO: 55472 - RNA, 20 nt, Artificial Sequence
  CIITA targeting sequence
agcgcuuuucaugccuguuu

SEQ ID NO: 55473 - RNA, 20 nt, Artificial Sequence
  CIITA targeting sequence
ugccuguuucacauccccug

SEQ ID NO: 55474 - RNA, 20 nt, Artificial Sequence
  CIITA targeting sequence
cauccccuggcugacaccac

SEQ ID NO: 55475 - RNA, 20 nt, Artificial Sequence
  CIITA targeting sequence
ccuggcugacaccacaugau

SEQ ID NO: 55476 - RNA, 20 nt, Artificial Sequence
  CIITA targeting sequence
gccaggggaugugaaacagg

SEQ ID NO: 55477 - RNA, 20 nt, Artificial Sequence
  CIITA targeting sequence
uguggugucagccaggggau

SEQ ID NO: 55478 - RNA, 20 nt, Artificial Sequence
  CIITA targeting sequence
agcccuugaugacauauguc

SEQ ID NO: 55479 - RNA, 20 nt, Artificial Sequence
  CIITA targeting sequence
agggcuagaucauguggugu

SEQ ID NO: 55480 - RNA, 20 nt, Artificial Sequence
  CIITA targeting sequence
ucaagggcuagaucaugugg

SEQ ID NO: 55481 - RNA, 20 nt, Artificial Sequence
  CIITA targeting sequence
uccuccugcauccuaauugc

SEQ ID NO: 55482 - RNA, 20 nt, Artificial Sequence
  CIITA targeting sequence
uccugcauccuaauugcuuc

SEQ ID NO: 55483 - RNA, 20 nt, Artificial Sequence
  CIITA targeting sequence
ugcauccuaauugcuuccug

SEQ ID NO: 55484 - RNA, 20 nt, Artificial Sequence
  CIITA targeting sequence
uaauugcuuccugucugcaa

SEQ ID NO: 55485 - RNA, 20 nt, Artificial Sequence
  CIITA targeting sequence
ugucugcaaguuagcuucua

SEQ ID NO: 55486 - RNA, 20 nt, Artificial Sequence
  CIITA targeting sequence
gcaaguuagcuucuauuaau

SEQ ID NO: 55487 - RNA, 20 nt, Artificial Sequence
  CIITA targeting sequence
auuaauauuucccuaacugg

SEQ ID NO: 55488 - RNA, 20 nt, Artificial Sequence
  CIITA targeting sequence
cuaacuggaccauauuacgu

SEQ ID NO: 55489 - RNA, 20 nt, Artificial Sequence
  CIITA targeting sequence
aguuagggaaauauuaauag

SEQ ID NO: 55490 - RNA, 20 nt, Artificial Sequence
  CIITA targeting sequence
cugcccaccccaggggaagg

SEQ ID NO: 55491 - RNA, 20 nt, Artificial Sequence
  CIITA targeting sequence
gcccaccccaggggaaggga

SEQ ID NO: 55492 - RNA, 20 nt, Artificial Sequence
  CIITA targeting sequence
ccuggggugggcagagagua

SEQ ID NO: 55493 - RNA, 20 nt, Artificial Sequence
  CIITA targeting sequence
cuuccccuggggugggcaga

SEQ ID NO: 55494 - RNA, 20 nt, Artificial Sequence
  CIITA targeting sequence
caucccuuccccuggggugg

SEQ ID NO: 55495 - RNA, 20 nt, Artificial Sequence
  CIITA targeting sequence
auauuuccccacgagggcuu

SEQ ID NO: 55496 - RNA, 20 nt, Artificial Sequence
  CIITA targeting sequence
ccacgagggcuugagaaagc

SEQ ID NO: 55497 - RNA, 20 nt, Artificial Sequence
  CIITA targeting sequence
uggggaaauauagaucacau

SEQ ID NO: 55498 - RNA, 20 nt, Artificial Sequence
  CIITA targeting sequence
agcccucguggggaaauaua

SEQ ID NO: 55499 - RNA, 20 nt, Artificial Sequence
  CIITA targeting sequence
caagcccucguggggaaaua

SEQ ID NO: 55500 - RNA, 20 nt, Artificial Sequence
  CIITA targeting sequence
gacauccuugcacagcugag

SEQ ID NO: 55501 - RNA, 20 nt, Artificial Sequence
  CIITA targeting sequence
gaugcacuuggcuuucucaa

SEQ ID NO: 55502 - RNA, 20 nt, Artificial Sequence
  CIITA targeting sequence
uugcacagcugaggucuccu

SEQ ID NO: 55503 - RNA, 20 nt, Artificial Sequence
  CIITA targeting sequence
gcugugcaaggaugucagau

SEQ ID NO: 55504 - RNA, 20 nt, Artificial Sequence
  CIITA targeting sequence
ccugugcccauauggcacau

SEQ ID NO: 55505 - RNA, 20 nt, Artificial Sequence
  CIITA targeting sequence
ugugcccauauggcacaucu

SEQ ID NO: 55506 - RNA, 20 nt, Artificial Sequence
  CIITA targeting sequence
aucccaucuaugacagggua

SEQ ID NO: 55507 - RNA, 20 nt, Artificial Sequence
  CIITA targeting sequence
caucuaugacaggguaucua

SEQ ID NO: 55508 - RNA, 20 nt, Artificial Sequence
  CIITA targeting sequence
augacaggguaucuauggca

SEQ ID NO: 55509 - RNA, 20 nt, Artificial Sequence
  CIITA targeting sequence
uagaugggauagaugugcca

SEQ ID NO: 55510 - RNA, 20 nt, Artificial Sequence
  CIITA targeting sequence
auggcaucagcucauuagaa

SEQ ID NO: 55511 - RNA, 20 nt, Artificial Sequence
  CIITA targeting sequence
gcucauuagaagugucuauu

SEQ ID NO: 55512 - RNA, 20 nt, Artificial Sequence
  CIITA targeting sequence
uuagaagugucuauuuuuuu

SEQ ID NO: 55513 - RNA, 20 nt, Artificial Sequence
  CIITA targeting sequence
aaugagcugaugccauagau

SEQ ID NO: 55514 - RNA, 20 nt, Artificial Sequence
  CIITA targeting sequence
auuuuuuuuuuuuuuuuuuu

SEQ ID NO: 55515 - RNA, 20 nt, Artificial Sequence
  CIITA targeting sequence
aaaaaaaaaaaaaaaaaaua

SEQ ID NO: 55516 - RNA, 20 nt, Artificial Sequence
  CIITA targeting sequence
caaaaaaaaaaaaaaaaaaa

SEQ ID NO: 55517 - RNA, 20 nt, Artificial Sequence
  CIITA targeting sequence
gucucaaaaaaaaaaaaaaa

SEQ ID NO: 55518 - RNA, 20 nt, Artificial Sequence
  CIITA targeting sequence
cccucuguugcccaggcugg

SEQ ID NO: 55519 - RNA, 20 nt, Artificial Sequence
  CIITA targeting sequence
cucuguugcccaggcuggag

SEQ ID NO: 55520 - RNA, 20 nt, Artificial Sequence
  CIITA targeting sequence
guugcccaggcuggagugca

SEQ ID NO: 55521 - RNA, 20 nt, Artificial Sequence
  CIITA targeting sequence
agccugggcaacagagggag

SEQ ID NO: 55522 - RNA, 20 nt, Artificial Sequence
  CIITA targeting sequence
cggcucacugcaagcuccac

SEQ ID NO: 55523 - RNA, 20 nt, Artificial Sequence
  CIITA targeting sequence
gcucacugcaagcuccaccu

SEQ ID NO: 55524 - RNA, 20 nt, Artificial Sequence
  CIITA targeting sequence
cugcaagcuccaccuuccag

SEQ ID NO: 55525 - RNA, 20 nt, Artificial Sequence
  CIITA targeting sequence
accuuccagguucaagcaau

SEQ ID NO: 55526 - RNA, 20 nt, Artificial Sequence
  CIITA targeting sequence
agguucaagcaauuguccug

SEQ ID NO: 55527 - RNA, 20 nt, Artificial Sequence
  CIITA targeting sequence
agcaauuguccugccucagc

SEQ ID NO: 55528 - RNA, 20 nt, Artificial Sequence
  CIITA targeting sequence
ugccucagccucccgaguag

SEQ ID NO: 55529 - RNA, 20 nt, Artificial Sequence
  CIITA targeting sequence
gccucccgaguagccgagau

SEQ ID NO: 55530 - RNA, 20 nt, Artificial Sequence
  CIITA targeting sequence
cgaguagccgagauuacagg

SEQ ID NO: 55531 - RNA, 20 nt, Artificial Sequence
  CIITA targeting sequence
ggaggcugaggcaggacaau

SEQ ID NO: 55532 - RNA, 20 nt, Artificial Sequence
  CIITA targeting sequence
gcuacucgggaggcugaggc

SEQ ID NO: 55533 - RNA, 20 nt, Artificial Sequence
  CIITA targeting sequence
cggcuacucgggaggcugag

SEQ ID NO: 55534 - RNA, 20 nt, Artificial Sequence
  CIITA targeting sequence
acuaaaaguacaaaaacuag

SEQ ID NO: 55535 - RNA, 20 nt, Artificial Sequence
  CIITA targeting sequence
cuacuaaaaguacaaaaacu

SEQ ID NO: 55536 - RNA, 20 nt, Artificial Sequence
  CIITA targeting sequence
ucucuacuaaaaguacaaaa

SEQ ID NO: 55537 - RNA, 20 nt, Artificial Sequence
  CIITA targeting sequence
ccaugcuggccagguugguc

SEQ ID NO: 55538 - RNA, 20 nt, Artificial Sequence
  CIITA targeting sequence
cgaacucaugaccucaagug

SEQ ID NO: 55539 - RNA, 20 nt, Artificial Sequence
  CIITA targeting sequence
aacucaugaccucaagugau

SEQ ID NO: 55540 - RNA, 20 nt, Artificial Sequence
  CIITA targeting sequence
agaccaaccuggccagcaug

SEQ ID NO: 55541 - RNA, 20 nt, Artificial Sequence
  CIITA targeting sequence
ugaccucaagugaucuaccc

SEQ ID NO: 55542 - RNA, 20 nt, Artificial Sequence
  CIITA targeting sequence
ugaguucgagaccaaccugg

SEQ ID NO: 55543 - RNA, 20 nt, Artificial Sequence
  CIITA targeting sequence
agugaucuacccaccucagc

SEQ ID NO: 55544 - RNA, 20 nt, Artificial Sequence
  CIITA targeting sequence
cuugaggucaugaguucgag

SEQ ID NO: 55545 - RNA, 20 nt, Artificial Sequence
  CIITA targeting sequence
acccaccucagccucccgaa

SEQ ID NO: 55546 - RNA, 20 nt, Artificial Sequence
  CIITA targeting sequence
gccucccgaagugcugggau

SEQ ID NO: 55547 - RNA, 20 nt, Artificial Sequence
  CIITA targeting sequence
cgaagugcugggauuacagg

SEQ ID NO: 55548 - RNA, 20 nt, Artificial Sequence
  CIITA targeting sequence
ggaggcugagguggguagau

SEQ ID NO: 55549 - RNA, 20 nt, Artificial Sequence
  CIITA targeting sequence
cagcacuucgggaggcugag

SEQ ID NO: 55550 - RNA, 20 nt, Artificial Sequence
  CIITA targeting sequence
ggccaggugugguggcuuac

SEQ ID NO: 55551 - RNA, 20 nt, Artificial Sequence
  CIITA targeting sequence
auuuuuuaaacaagaaaaga

SEQ ID NO: 55552 - RNA, 20 nt, Artificial Sequence
  CIITA targeting sequence
uguuuaaaaaauagacacuu

SEQ ID NO: 55553 - RNA, 20 nt, Artificial Sequence
  CIITA targeting sequence
uuucuuguuuaaaaaauaga

SEQ ID NO: 55554 - RNA, 20 nt, Artificial Sequence
  CIITA targeting sequence
uccucacugacaaauuccaa

SEQ ID NO: 55555 - RNA, 20 nt, Artificial Sequence
  CIITA targeting sequence
ucacugacaaauuccaaaua

SEQ ID NO: 55556 - RNA, 20 nt, Artificial Sequence
  CIITA targeting sequence
cugacaaauuccaaauagua

SEQ ID NO: 55557 - RNA, 20 nt, Artificial Sequence
  CIITA targeting sequence
gugaggaagauuugucuuuu

SEQ ID NO: 55558 - RNA, 20 nt, Artificial Sequence
  CIITA targeting sequence
aaauaguaugaguagauacu

SEQ ID NO: 55559 - RNA, 20 nt, Artificial Sequence
  CIITA targeting sequence
uacuauuuggaauuugucag

SEQ ID NO: 55560 - RNA, 20 nt, Artificial Sequence
  CIITA targeting sequence
acucauacuauuuggaauuu

SEQ ID NO: 55561 - RNA, 20 nt, Artificial Sequence
  CIITA targeting sequence
cucuccaggggaugcacuuu

SEQ ID NO: 55562 - RNA, 20 nt, Artificial Sequence
  CIITA targeting sequence
ccaggggaugcacuuuuauu

SEQ ID NO: 55563 - RNA, 20 nt, Artificial Sequence
  CIITA targeting sequence
aggggaugcacuuuuauuuu

SEQ ID NO: 55564 - RNA, 20 nt, Artificial Sequence
  CIITA targeting sequence
ccuggagagggaguaucuac

SEQ ID NO: 55565 - RNA, 20 nt, Artificial Sequence
  CIITA targeting sequence
uuuuuugagacagggucuca

SEQ ID NO: 55566 - RNA, 20 nt, Artificial Sequence
  CIITA targeting sequence
aaaaaagaaaauaaaauaaa

SEQ ID NO: 55567 - RNA, 20 nt, Artificial Sequence
  CIITA targeting sequence
caaaaaaagaaaauaaaaua

SEQ ID NO: 55568 - RNA, 20 nt, Artificial Sequence
  CIITA targeting sequence
cacucugucacccaggcugg

SEQ ID NO: 55569 - RNA, 20 nt, Artificial Sequence
  CIITA targeting sequence
cucugucacccaggcuggag

SEQ ID NO: 55570 - RNA, 20 nt, Artificial Sequence
  CIITA targeting sequence
gucacccaggcuggagugca

SEQ ID NO: 55571 - RNA, 20 nt, Artificial Sequence
  CIITA targeting sequence
cccaggcuggagugcagugg

SEQ ID NO: 55572 - RNA, 20 nt, Artificial Sequence
  CIITA targeting sequence
agccugggugacagagugag
